(12) United States Patent
Liang et al.

(10) Patent No.: US 11,987,612 B2
(45) Date of Patent: May 21, 2024

(54) SIGLEC-9 ECD FUSION MOLECULES

(71) Applicant: Alector LLC, South San Francisco, CA (US)

(72) Inventors: Spencer Liang, San Mateo, CA (US); Samuel Nalle, Pacifica, CA (US); Jeonghoon Sun, San Francisco, CA (US); Hua Long, San Carlos, CA (US); Rashmi Bankoti, San Carlos, CA (US)

(73) Assignee: Alector LLC, South San Francisco, CA (US)

( * ) Notice: Subject to any disclaimer, the term of this patent is extended or adjusted under 35 U.S.C. 154(b) by 601 days.

(21) Appl. No.: 17/088,149

(22) Filed: Nov. 3, 2020

(65) Prior Publication Data

US 2021/0284710 A1 Sep. 16, 2021

Related U.S. Application Data

(60) Provisional application No. 63/092,753, filed on Oct. 16, 2020, provisional application No. 63/014,940, filed on Apr. 24, 2020, provisional application No. 62/930,227, filed on Nov. 4, 2019.

(51) Int. Cl.

| C07K 14/705 | (2006.01) |
|---|---|
| A61K 38/17 | (2006.01) |
| A61K 39/00 | (2006.01) |
| A61K 45/06 | (2006.01) |
| A61P 35/00 | (2006.01) |
| A61P 35/04 | (2006.01) |
| C07K 16/28 | (2006.01) |

(52) U.S. Cl.
CPC .... *C07K 14/70503* (2013.01); *A61K 38/1774* (2013.01); *A61K 45/06* (2013.01); *A61P 35/00* (2018.01); *A61P 35/04* (2018.01); *C07K 16/2818* (2013.01); *C07K 16/2827* (2013.01); *A61K 2039/545* (2013.01); *C07K 2317/76* (2013.01); *C07K 2319/30* (2013.01)

(58) Field of Classification Search
CPC .......... C07K 2319/30; C07K 14/70503; A61K 38/1774
See application file for complete search history.

(56) References Cited

U.S. PATENT DOCUMENTS

| 9,962,428 B2 | 5/2018 | Yamamoto et al. |
|---|---|---|
| 2018/0311313 A1 | 11/2018 | Yamamoto et al. |

FOREIGN PATENT DOCUMENTS

| NO | 2019191519 A1 | 10/2019 |
|---|---|---|
| WO | 2007049044 A1 | 5/2007 |
| WO | 2007120815 A2 | 10/2007 |
| WO | 2014098249 A1 | 6/2014 |
| WO | 2014120642 A1 | 8/2014 |
| WO | 2016038064 A1 | 3/2016 |
| WO | 2016178996 A1 | 11/2016 |
| WO | 2017075342 A1 | 5/2017 |
| WO | 2017075432 A2 | 5/2017 |
| WO | 2017085166 A1 | 5/2017 |
| WO | 2017123745 A1 | 7/2017 |
| WO | 2017153433 A1 | 9/2017 |
| WO | 2018002640 A2 | 1/2018 |
| WO | 2018006066 A1 | 1/2018 |
| WO | 2018002640 A3 | 4/2018 |
| WO | 2019011852 A1 | 1/2019 |
| WO | 2019011855 A1 | 1/2019 |
| WO | 2019237070 A1 | 12/2019 |
| WO | 2020006385 A2 | 1/2020 |
| WO | 2020006385 A3 | 2/2020 |
| WO | 2020072593 A1 | 4/2020 |
| WO | 2020212986 A1 | 10/2020 |
| WO | 2020247372 A1 | 12/2020 |
| WO | 2021011377 A2 | 1/2021 |

OTHER PUBLICATIONS

Alphey, M.S. et al. (Jan. 31, 2003). "High Resolution Crystal Structures of Siglec-7," The Journal of Biological Chemistry 278(5):3372-3377.
Ando, M. et al. (May 9, 2008; e-pub. Mar. 4, 2008). "Siglec-9 Enhances IL-10 Production in Macrophages via Tyrosine-Based Motifs," Biochem. And Biophys. Res. Comm. 369(3):878-883.
Angata, T. et al. (Jul. 21, 2000). "Cloning, Characterization, and Phylogenetic Analysis of Siglec-9, a New Member of the CD33-related Group of Siglecs," J. Biol. Chem. 275(29):22127-22135.
Attrill, H. et al. (Oct. 27, 2006; e-published on Aug. 8, 2006). "Siglec-7 Undergoes a Major Conformational Change When Complexed with the α(2,8)-Disialylganglioside GT1b," J. Biol. Chem. 281:32774-32783.
Avril, T. et al. (Dec. 1, 2004). "The Membrane-Proximal Immunoreceptor Tyrosine-Based Inhibitory Motif is Critical for the Inhibitory Signaling Mediated by Siglecs-7 and -9, CD33-Related Siglecs Expressed on Human Monocytes and NK Cells," J Immunol. 173(11):6841-6849.
Belisle, J.A. et al. (May 24, 2010). "Identification of Siglec-9 as the receptor for MUC16 on human NK cells, B cells, and monocytes," Molecular Cancer 9:118, pp. 1-14.
Biedermann, B. et al. (Dec. 6, 2006, e-pub. Jul. 10, 2006). "Analysis of the CD33-Related Siglec Family Reveals That Siglec-9 is an Endocytic Receptor Expressed on Subsets of Acute Myeloid Leukemia Cells and Absent From Normal Hematopoietic Progenitors," Leukemia Research 31(2):211-220.
Bornhöfft et al., "Siglecs: A journey through the evolution of sialic acid-binding immunoglobulin-type lectins", Developmental and Comparative Immunology, 2018, vol. 86, pp. 219-231.
Capel, P.J.A. et al. (1994). "Heterogeneity of Human IgG Fc Receptors," Immunomethods4:25-34.

(Continued)

Primary Examiner — Elly-Gerald Stoica
(74) Attorney, Agent, or Firm — McNeill Baur PLLC

(57) ABSTRACT

The present disclosure is generally directed to Siglec-9 ECDs and Siglec-9 ECD fusion molecules, and methods of treatment using Siglec-9 ECDs and Siglec-9 ECD fusion molecules.

20 Claims, 35 Drawing Sheets
Specification includes a Sequence Listing.

(56) References Cited

OTHER PUBLICATIONS

Carlin, A.F. et al (Apr. 2, 2009, e-pub. Feb. 4, 2009). "Molecular Mimicry of Host Sialylated Glycans Allows a Bacterial Pathogen to Engage Neutrophil Siglec-9 and Dampen the Innate Immune Response," Blood 113 (14):3333-3336.
Chen et al., "Broad and direct interaction between TLR and Siglec families of pattern recognition receptors and its regulation by Neu1", eLife, 2014, 18 pages.
Crocker, P . R . et al. (Jun. 1, 2001). "Siglecs, Sialic Acids and Innate Immunity," Trends Immunol. 22 (6):337-342.
Crocker, P.R. et al. (Apr. 2007). "Siglecs and their Roles in the Immune System," Nat Rev Immunol. 7(4):255-266.
Crocker, P.R. et al. (Apr. 2012; e-published on Feb. 21, 2012). "CD33-related Siglecs as Potential Modulators of Inflammatory Responses," Ann. NY Acad. Sci.1253:102-111.
Daëron, M. (1997). "FC Receptor Biology," Annu. Rev. Immunol. 15:203-234.
Dall'Acqua, W.F. et al. (Aug. 18, 2006). "Properties of Human lgG1s Engineered for Enhanced Binding to the Neonatal Fc Receptor (FcRn)," The Journal Of Biological Chemistry 281(33):23514-23524.
De Haas, M. et al. (1995). "Fcγ Receptors of Phagocytes," J. Lab. Clin. Med. 126(4):330-341.
European Patent Office, International Search Report and Written Opinion issued in International Patent Application No. PCT/US202/058687, dated May 11, 2021.
Haas et al., "Siglec-9 Regulates an Effector Memory CD8+ T-cell Subset That Congregates in the Melanoma Tumor Microenvironment", Cancer Immunology Research, 2019, pp. 707-719.
Barlucea-Benitez et al., "Siglecs-7/9 function as inhibitory immune checkpoints in vivo and can be targeted to enhance therapeutic antitumor immunity", PNAS, Jun. 2021, 10 pages.
Ikehara, Y. et al. (Oct. 8, 2004; e-pub. Aug. 3, 2004). "Negative Regulation of T Cell Receptor Signaling by Siglec-7 (p70/AIRM) and Siglec-9," J. Biol. Chem. 279(41):43117-43125.
Ito et al., "Secreted Ectodomain of SIGLEC-9 and MCP-1 Synergistically Improve Acute Liver Failure in Rats by Altering Macrophage Polarity", Scientific Reports, 2017, 12 pages.
Jandus et al., "Interactions between Siglec-7/9 receptors and ligands influence NK cell-dependent tumor immunosurveillance", The Journal of Clinical Investigation, 2014, vol. 124, No. 4, pp. 1810-1820.
Jia et al., "Expression of ligands for Siglec-8 and Siglec-9 in human airways and airway cells", Journal Allergy Clinical Immunology, vol. 135, No. 3, pp. 799-810.e7.
Läubli, H. et al (Sep. 30, 2014). "Engagement of Myelomonocytic Siglecs by Tumor-Associated Ligands Modulates the Innate Immune Response to Cancer," PNAS 111(39):14211-14216.
Azar, G.A. et al. (Mar. 14, 2006). "Engineered Antibody Fc variants with Enhanced Effector Function," PNAS 103 (11):4005-4010.
Lubbers et al., "Modulation of Immune Tolerance via Siglec-Sialic Acid Interactions", Frontiers in Immunology, Dec. 7, 2018, vol. 9, 13 pages.
Macauley, M.S. et al. (Oct. 2014; e-published on Sep. 19, 2014). "Siglec Regulation of Immune Cell Function in Disease," Nature Reviews Immunology 14(10):653-666, twenty nine pages.
Macauley, M.S. et al. (Jan. 2014). "Glyco-Engineering 'Super-Self'," Nat. Chem. Biol. 10(1):7-8.
Matsumoto et al., "Soluble Siglec-9 suppresses arthritis in a collagen-induced arthritis mouse model and inhibits M1 activation of RAW264.7 macrophages", Arthritis Research & Therapy, 2016, vol. 18, No. 133, 13 pages.
McMillan, S.J. et al. (Aug. 11, 2008; e-published on Jan. 17, 2008). "CD33-related Sialic-Acid-Binding Immunoglobulin-Like Lectins in Health and Disease," Carbohydrate Research 343(12):2050-2056.
McMillan, S.J. et al. (Mar. 14, 2013; e-pub. Jan. 11, 2013). "Siglec-E is a Negative Regulator of Acute Pulmonary Neutrophil Inflammation and Suppresses CD11b β2-Integrin-Dependent Signaling," Blood 121 (11):2084-2094.
Oganesyan, V. et al. (2008). "Structural characterization of a Human Fc Fragment Engineered for Lack of Effector Functions," Acta Crystallography 64:700-704.
O'Reilly, M.K. et al. (May 2009; e-published on Apr. 7, 2009). "Siglecs as Targets for Therapy in Immune Cell Mediated Disease," Trends Pharmacol. Sci. 30(5):240-248, twenty three pages.
Peters, S.J. et al. (Jul. 13, 2012). "Engineering an Improved lgG4 Molecule with Reduced Disulfide Bond Heterogeneity and Increased Fab Domain Thermal Stability," The Journal of Biological Chemistry 287(29):24525-24533.
Pillai, S. et al. (2012; Jan. 3, 2012). "Siglecs and Immune Regulation," Annu. Rev. Immunol. 30:357-392.
R&D Systems, "Recombinant Human Siglec-9 Fc Chimera", Product Datasheet, Catalog No. 1139-SL, 2018, 1 page.
Rodrigues et al., "A versatile soluble siglec scaffold for sensitive and quantitative detection of glycan ligands", Nature Communications, vol. 11, No. 5091, 2020, 13 pages.
Sabit et al., "Binding of a Sialic Acid-recognizing Lectin Siglec-9 Modulates Adhesion Dynamics of Cancer Cells via Calpain-mediated Protein Degradation", The Journal of Biological Chemistry, Dec. 6, 2013, vol. 288, No. 49, pp. 35417-35427.
Santegoets et al., "Expression profiling of immune inhibitory Siglecs and their ligands in patients with glioma", Cancer Immunology, 2019, vol. 68, pp. 937-949.
Shields, R.L. et al. (Mar. 2, 2001). "High Resolution Mapping of the Binding Site on Human lgG1 for FcγRI, FcγRII, FcγRIII, and FcRn and Design of lgG1 Variants with Improved Binding to the FcγR," The Journal Of Biological Chemistry 276(9):6591-6604.
Stanczak et al., "Self-associated molecular patterns mediate cancer immune evasion by engaging Siglecs on T cells", Journal of Clinical Investigation, 2018, vol. 128, No. 11, pp. 4912-4923.
Strohl, W.R. (2009; e-published on Nov. 4, 2009). "Optimization of Fc-mediated Effector Functions of Monoclonal Antibodies," Current Opinion in Biotechnology 20:685-691.
Vafa, O. et al. (2014; e-published on Jul. 17, 2013). "An Engineered Fc Variant of an lgG Eliminates All Immune Effector Functions Via Structural Perturbations," Methods 65:114-126.
Varki, A. et al. (Jan. 1, 2006; e-published on Jul. 13, 2005). "Siglecs—The Major Subfamily of I-Type Lectins," Glycobiology 16(1):1R-27R.
Vincent, K.J. et al. (Dec. 2012; e-pub. Nov. 1, 2012). "Current Strategies in Antibody Engineering: Fc Engineering and pH-dependent Antigen Binding, Bispecific Antibodies And Antibody Drug Conjugates," Biotechnol J. 7(12):1444-1450.
Von Gunten, S. et al. (Aug. 15, 2005). "Siglec-9 Transduces Apoptotic and Nonapoptotic Death Signals into Neutrophils Depending on the Proinflammatory Cytokine Environment," Blood 106(4):1423-1431.
Von Gunten, S. et al. (Nov. 1, 2008). "Basic and Clinical Immunology of Siglecs," Annals of The New York Academy Of Sciences 1143(1):61-82, twenty five pages.
Wang et al., "Siglec-9 is upregulated in rheumatoid arthritis and suppresses collagen-induced arthritis through reciprocal regulation of Th17-/Treg-cell differentiation", Experimental Immunology, 2017, No. 85, pp. 433-440.
Wilson, N.S. et al. (Jan. 18, 2011). "An Fcγ Receptor-Dependent Mechanism Drives Antibody-Mediated Target-Receptor Signaling in Cancer Cells," Cancer Cell 19:101-113.
Yamaji, T. et al. (Feb. 22, 2002). "A Small Region of the Natural Killer Cell Receptor, Siglec-7, Is Responsible for Its Preferred Binding to α2,8-Disialyl and Branched α2,6-Sialyl Residues," J. Biol. Chem. 277(8):6324-6332.
Yu, Z. et al. (Feb. 1, 2001). "mSiglec-E, a Novel Mouse CD33-Related Siglec (Sialic Acid-Binding Immunoglobulin-Like Lectin) that Recruits Src Homology 2 (SH2)-Domain-Containing Protein Tyrosine Phosphatases SHP-1 and SHP-2," Biochem. J. 353(Pt 3):483-492.

(56) References Cited

OTHER PUBLICATIONS

Zeng et al., "Increased expression of Siglec-9 in chronic obstructive pulmonary disease", Scientific Reports, 2017, No. 7, vol. 10116, 12 pages.

Zhang, J. Q. et al. (Jul. 21, 2000). "SIGLEC-9, A Novel Sialic Acid Binding Member of The Immunoglobulin Superfamily Expressed Broadly on Human Blood Leukocytes," Journal of Biological Chemistry 275(29):22121-22126.

Ravetch et al., "Siglecs-7/9 function as inhibitory immune checkpoints in vivo and can be targeted to enhance therapeutic antitumor immunity", PNAS 2021, vol. 118 No. 26, 10 pgs.

Daly, John, et al., "Sugar Free: Novel Immunotherapeutic Approaches Targeting Siglecs and Sialic Acids to Enhance Natural Killer Cell Cytotoxicity Against Cancer", Frontiers in Immunology, vol. 10, Jan. 1, 2019, p. 1047.

Foussias, G., et al., "Identification and Molecular Characterization of a Novel Member of the Siglec Family (SIGLEC9)", Genomics, Academic Press, San Diego, US, 67(2):171-178 (Jul. 15, 2000).

Nguyen, D. H., et al., "Myeloid precursors and acute myeloid leukemia cells express multiple CD33-related Siglecs", Experimental Hematology, vol. 34, No. 6, Jun. 1, 2006, pp. 728-735.

Novoprolabs: "Commonly used leader peptide sequences for mammalian cells expression", Apr. 21, 2018.

Sharp, K.S., et al., "Electrostatic Interactions in Macromolecules: Theory and Applications", Annual Review of Biophysics and Bioengineering, 19(1):301-332 (Jun. 1, 1990).

Von Gunten, Stephan, et al., "Basic and Clinical Immunology of Siglecs", Annals of the New York Academy of Sciences, vol. 1143, No. 1, Nov. 1, 2008, pp. 61-82.

Wildman, S.A., et al., "Prediction of Physiocochemical Parameters by Atomic Contributions", Journal of Chemical Information and Computer Sciences, American Chemical Society, Colombus, Ohio, US, 39(5):868-873 (Jan. 1, 1999).

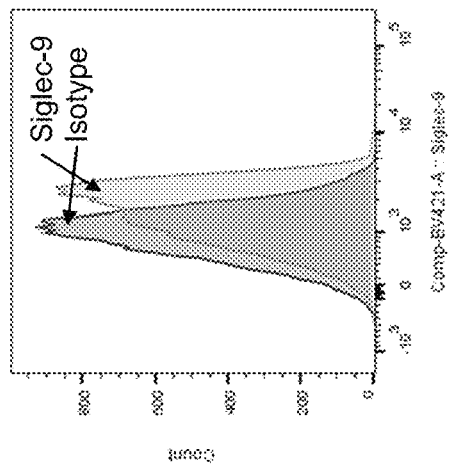
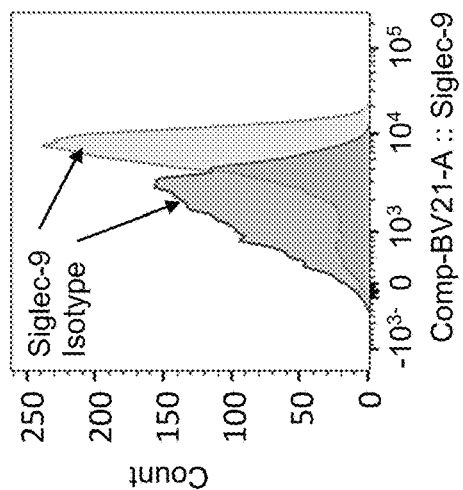

FIG. 1

>Human siglec 9

MLLLLLLPLLWGRERAEGQTSKLLTMQSSVTVQEGLCVHVPCSFSYPSHGWIYPGPVVHGYWFREGANIDQDAPVATNNPARAVWEETRDRFHLLGDPHTKNCTLSIR
DARRSDAGRYFFRMEKGSIKWNYKHHRLSVNVTALTHRPNILIPGTLESGCPQNLTCSVPWACEQGTPPMLSWIGTSVSPLDPSTTRSSVLTLIPQPQDHGTSLTCQ
VTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPNVHLRDAAEFTCR
AQNPLGSQQVYLNVSLQSKATSGVTQGVGVVGAGATALVFLSFCVIFVVVRSCRKKSARPAAGVGDTGIEDANAVRGSASQGPLTEPWAEDSPPDQPPPASARSSVGE
GELQYASLSFQMVKPWDSRGQEATDLEYSEIKIHR (SEQ ID NO: 1)

FIG. 2

| Variant | Mutations | Stability change Kcal/mol | Hydrophobic patch Å² | Positive patch Å² | Negative patch Å² | pI | Net charge |
|---|---|---|---|---|---|---|---|
| S9.1 (wt) | 1:W38W,1:I39I,1:Y40Y,1:P41P - parental | 0 | 410 | 330 | 40 | 9.42 | 4.85 |
| S9.2 | 1:W38D,1:I39I,1:Y40E,1:P41G | -0.86 | 220 | 270 | 40 | 8.68 | 3.21 |
| S9.3 | 1:W38S,1:I39I,1:Y40E,1:P41T | -0.59 | 220 | 270 | 40 | 9.22 | 3.91 |
| S9.4 | 1:W38S,1:I39I,1:Y40E,1:P41P | -0.58 | 280 | 270 | 40 | 9.22 | 3.9 |
| S9.5 | 1:W38D,1:I39I,1:Y40E,1:P41P | -0.52 | 220 | 270 | 40 | 8.68 | 3.18 |
| S9.6 | 1:W38Y,1:I39Q,1:Y40E,1:P41S | -0.38 | 220 | 270 | 40 | 9.07 | 3.92 |
| S9.7 | 1:W38T,1:I39H,1:Y40E,1:P41T | -0.04 | 220 | 270 | 40 | 9.2 | 3.99 |
| S9.8 | 1:L23T,1:H26S,1:H80Y,1:L82E | -0.44 | 430 | 280 | 40 | 9.16 | 3.38 |
| S9.9 | 1:L23T,1:H26T,1:H80Y,1:L82D | -0.3 | 430 | 280 | 90 | 9.14 | 3.38 |
| S9.10 | 1:S35D,1:W38T,1:I39I,1:Y40Y | -2.06 | 270 | 270 | 40 | 9.11 | 3.9 |
| S9.11 | 1:S35D,1:W38E,1:I39I,1:Y40Y | -1.81 | 270 | 270 | 40 | 8.63 | 2.97 |
| S9.12 | 1:S35S,1:W38S,1:I39H,1:Y40H | -1.32 | 220 | 270 | 40 | 9.47 | 4.95 |
| S9.13 | 1:S35D,1:W38Q,1:I39H,1:Y40E | -1.04 | 220 | 270 | 40 | 8.56 | 3.15 |
| S9.14 | 1:S35T,1:W38S,1:I39H,1:Y40E | -1.04 | 220 | 270 | 40 | 9.22 | 3.95 |
| S9.15 | 1:S35D,1:W38E,1:I39T,1:Y40Y | -1.02 | 220 | 270 | 40 | 8.6 | 2.98 |
| S9.16 | 1:S35N,1:W38T,1:I39E,1:Y40Y | -0.97 | 220 | 270 | 40 | 9.09 | 3.87 |
| S9.17 | 1:S35H,1:W38T,1:I39T,1:Y40T | -0.96 | 270 | 280 | 40 | 9.45 | 5.01 |
| S9.18 | 1:S35H,1:W38S,1:I39T,1:Y40T | -0.95 | 270 | 280 | 40 | 9.47 | 4.97 |
| S9.19 | 1:S35S,1:W38G,1:I39T,1:Y40E | -0.94 | 280 | 270 | 40 | 9.16 | 3.89 |
| S9.20 | 1:S8D,1:K9Y,1:L10T,1:W116E | -0.69 | 330 | 180 | 40 | 7.77 | 0.65 |
| S9.21 | 1:S8D,1:K9Y,1:L10Q,1:W116N | -0.48 | 330 | 170 | 40 | 8.26 | 2.35 |
| S9.22 | 1:S8E,1:K9Y,1:L10T,1:W116E | -0.41 | 390 | 190 | 40 | 7.72 | 1.39 |
| S9.26 | 1:S35V,1:H36H,1:G37G,1:W38Q,1:I39I,1:Y40D,1:P41S,1:G42D | -2.12 | 220 | 270 | 100 | 8.63 | 2.99 |
| S9.27 | 1:S35V,1:H36H,1:G37S,1:W38Q,1:I39I,1:Y40D,1:P41S,1:G42D | -1.73 | 220 | 270 | 130 | 8.63 | 2.99 |
| S9.28 | 1:S35V,1:H36D,1:G37S,1:W38Q,1:I39I,1:Y40D,1:P41S,1:G42D | -1.53 | 220 | 270 | 80 | 7.97 | 1.98 |
| S9.29 | 1:S35S,1:H36D,1:G37S,1:W38Q,1:I39I,1:Y40D,1:P41S,1:G42D | -1.17 | 220 | 270 | 80 | 7.97 | 1.99 |
| S9.30 | 1:S35V,1:H36D,1:G37G,1:W38Q,1:I39I,1:Y40D,1:P41S,1:G42D | -1.02 | 220 | 270 | 90 | 7.97 | 1.98 |

*FIG. 3*

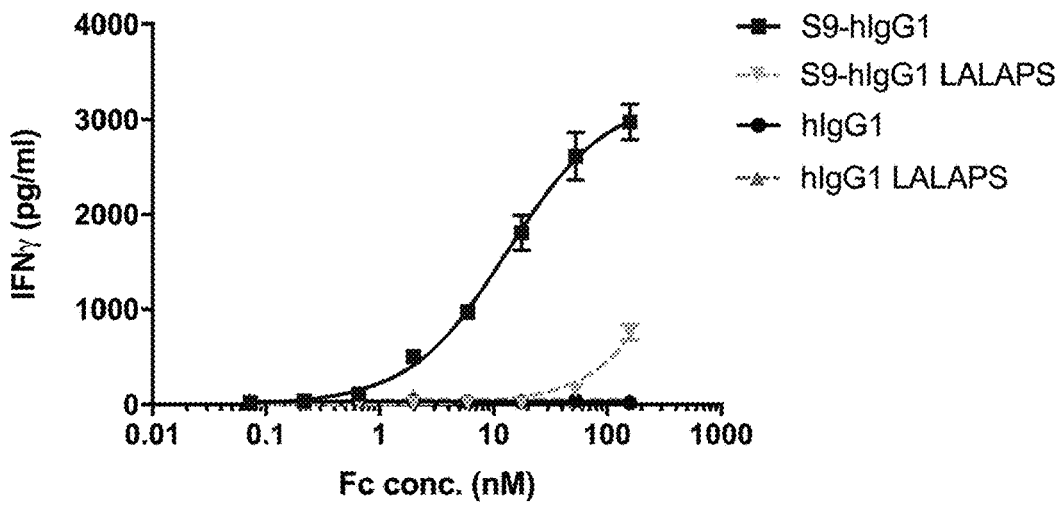
*FIG. 6*
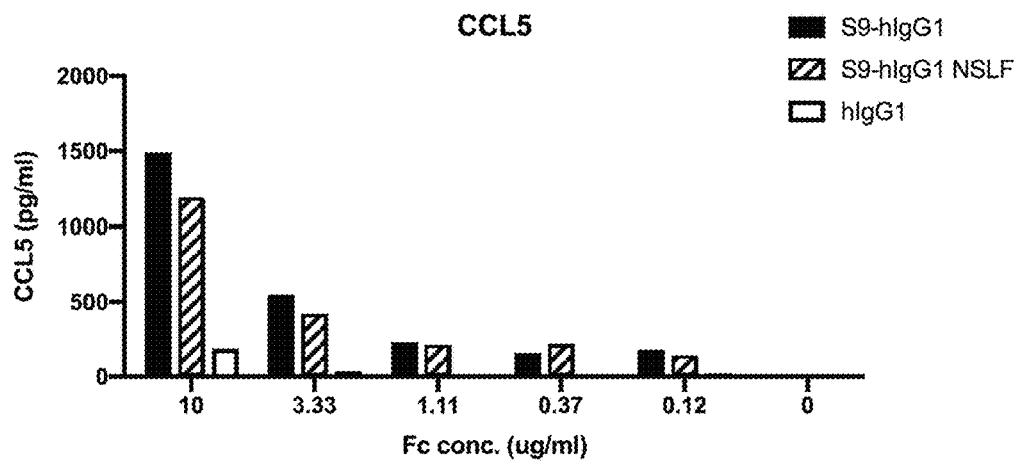
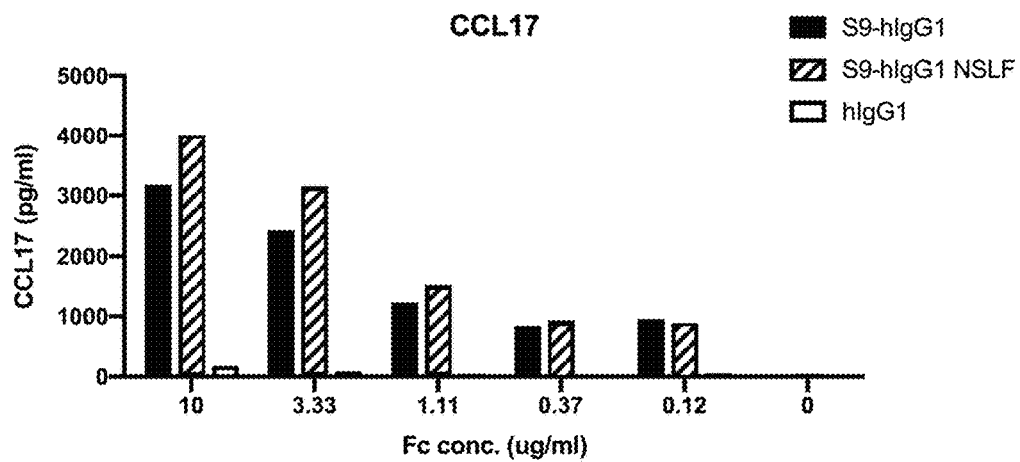
*FIG. 7*

| Variant | A375 binding MFI | MDSC CD86 MFI | MDSC CD163 MFI | Yield (mg) | DSF Tm1 | DSF Tm2 | Percent Monomer |
|---|---|---|---|---|---|---|---|
| S9.1 | 12470 | 45480 | 1297 | 17.1 | 59.7 | 69 | 92.4 |
| S9.2 | 7517 | 26778 | 2270 | 24.8 | 62.7 | 70.5 | 96.7 |
| S9.3 | 5807 | 33120 | 2252 | 53.8 | 60.7 | 70.5 | 97.6 |
| S9.4 | 7958 | 35921 | 2114 | 25 | 61.6 | 70.1 | 97.7 |
| S9.5 | 5160 | NA | NA | 17.9 | 61.2 | 71.1 | 98.2 |
| S9.6 | 7673 | NA | NA | 15.5 | 60.5 | 68.6 | 97.8 |
| S9.7 | 8119 | 32708 | 2227 | 11.1 | 60.6 | 70.7 | 97.7 |
| S9.8 | 7061 | NA | NA | 13.7 | 56.7 | 67.3 | 69.4 |
| S9.9 | 5877 | 40290 | 1734 | 44.5 | 57.5 | 72.4 | 73.9 |
| S9.10 | 6668 | 40555 | 1926 | 10.6 | 60.6 | 67.8 | 97.4 |
| S9.11 | 4042 | 24547 | 2066 | 46.9 | 58.1 | 69.5 | 98.4 |
| S9.12 | 12207 | NA | NA | 18.5 | 59.5 | 68.6 | 80.1 |
| S9.13 | 2702 | 26302 | 1984 | 29.1 | 61.7 | 67.2 | 97.7 |
| S9.14 | 7719 | 33470 | 2025 | 16.9 | 61.5 | 69.5 | 94.9 |
| S9.15 | 4359 | NA | NA | 17.5 | 61.5 | 67.9 | 98.7 |
| S9.16 | 7260 | 30178 | 2099 | 23.8 | 63 | 69 | 94.8 |
| S9.17 | 10546 | 33215 | 2088 | 22.7 | 62.5 | 69.5 | 92.5 |
| S9.18 | 11575 | 39959 | 2153 | 22.5 | 59.7 | 66.6 | 92.9 |
| S9.19 | 6195 | 29171 | 2222 | 42.5 | 61 | 68.3 | 99.1 |
| S9.20 | 572 | 22413 | 2028 | 35.6 | 58.4 | 70.3 | 94.9 |
| S9.21 | 875 | NA | NA | 5.5 | 61.8 | 70.1 | 77.2 |
| S9.22 | 436 | NA | NA | 33.2 | 58.8 | 71.4 | 96.5 |
| S9.23 | 5416 | 28651 | 2230 | 31 | 62.2 | 69.8 | 97.8 |
| S9.24 | 4886 | 28290 | 2037 | 47.5 | 60.8 | 70 | 98.1 |
| S9.25 | 2902 | NA | NA | 41.2 | 62 | 71.9 | 97.9 |
| S9.26 | 5969 | 20251 | 2021 | 47.4 | 61.8 | 71.5 | 98 |
| S9.27 | 5360 | 21196 | 1970 | 49.2 | 61.6 | 71.6 | 98.1 |
| S9.28 | 2437 | 18270 | 2240 | 50.9 | 62.2 | 71.9 | 97.9 |
| S9.29 | 1828 | NA | NA | 55.1 | 62.3 | 70.6 | 97.6 |
| S9.30 | 2106 | 19547 | 2321 | 52.3 | 62.2 | 72.3 | |

FIG. 18

| Variant | SEQ ID NO: | Name | Yield (mg) | A375 binding at 28 ug/ml (MedFI) | MDSC CD86 at 10 ug/ml (MedFI) | MDSC CD163 at 10 ug/ml (MedFI) | MDSC CD11b at 10 ug/ml (MedFI) |
|---|---|---|---|---|---|---|---|
| S9.1 | 48 | WT hIgG1 | 53.4 | 64385 | 17963 | 1433 | 9295 |
| S9.32 | 171 | W38T | 52.7 | 53113 | 18819 | 1713 | 8903 |
| S9.33 | 172 | W38E | 69.0 | 52649 | 13180 | 2087 | 8089 |
| S9.34 | 173 | W38S | 77.3 | 52804 | 18886 | 1633 | 8863 |
| S9.35 | 174 | W38A | 40.8 | 69502 | 18180 | 1487 | 8953 |
| S9.36 | 175 | W38R | 42.3 | 66284 | 19364 | 1273 | 9028 |
| S9.37 | 176 | W38Q | 43.2 | 47014 | 18231 | 1470 | 9013 |
| S9.38 | 177 | W38K | 42.9 | 56372 | 19669 | 1267 | 9149 |
| S9.39 | 178 | W38S_Y40T | 31.0 | 37418 | 13981 | 1891 | 8292 |
| S9.10 | 57 | S35D_W38T | 46.0 | 38417 | 13752 | 1846 | 7627 |
| S9.41 | 179 | L_ER_R | 35.1 | 136272 | 11883 | 1920 | 6786 |
| S9.42 | 180 | D_SI_R | 35.2 | 66444 | 9139 | 1852 | 6571 |
| S9.43 | 181 | L_KI_R | 35.4 | 154017 | 16242 | 1560 | 7066 |
| S9.44 | 182 | T_EI_E | 33.8 | 23450 | 8981 | 2128 | 7162 |
| S9.45 | 183 | S_QI_R | 37.3 | 215774 | 8987 | 1754 | 6762 |
| S9.47 | 184 | R_SS_I_T | 6.8 | 9260 | 8817 | 1920 | 6636 |
| S9.48 | 185 | R_DS_I_T | 9.9 | 8049 | 9443 | 2014 | 6306 |
| S9.49 | 186 | G_VT_Q_T | 39.2 | 58239 | 18384 | 1551 | 7947 |

Signal sequences cleaved during production)

FIG. 31

| Variant (SEQ ID NO) | Dose (mg/kg) | Animal # | C₀ (ng/mL) | Cmax (ng/mL) | AUC₀-t (ng*hr/mL) | AUC₀-inf (ng*hr/mL) | CL (mL/hr/kg) | tmax (hr) | t₁/₂ (hr) | Vss (mL/kg) |
|---|---|---|---|---|---|---|---|---|---|---|
| S9.1 (SEQ ID NO:48) | 10 | Mean | 9970 | 6660 | 58000 | 61400 | 164 | 1 | 29 | 3950 |
| | | SD | 978 | 646 | 5110 | 5540 | 15.5 | NA | 6.01 | 836 |
| S9.36 (SEQ ID NO:175) | 10 | Mean | 7560 | 5050 | 50800 | 53300 | 190 | 1 | 27.6 | 5290 |
| | | SD | 1630 | 973 | 9620 | 7280 | 24.5 | NA | 4.16 | 1190 |
| S9.37 (SEQ ID NO:176) | 10 | Mean | 24200 | 15300 | 130000 | 136000 | 75.5 | 1 | 29.4 | 1920 |
| | | SD | 8540 | 4440 | 15300 | 24100 | 11.8 | NA | 8.34 | 222 |
| S9.38 (SEQ ID NO:177) | 10 | Mean | 16000 | 10000 | 72800 | 77200 | 131 | 1 | 32.1 | 3070 |
| | | SD | 3730 | 2110 | 9890 | 8660 | 14.9 | NA | 11.4 | 982 |
| S9.39 (SEQ ID NO:178) | 10 | Mean | 9340 | 6160 | 41900 | 42400 | 242 | 1 | 30 | 3290 |
| | | SD | 2710 | 1470 | 6750 | 6730 | 43.9 | NA | 9.49 | 902 |

(Signal sequences cleaved during production)

FIG. 34

SIGLEC-9 ECD FUSION MOLECULES

CROSS-REFERENCE TO RELATED APPLICATIONS

This application claims the benefit of priority of US Provisional Application Nos. 62/930,227, filed Nov. 4, 2019, 63/014,940, filed Apr. 24, 2020, and 63/092,753, filed Oct. 16, 2020, all of which are incorporated by reference herein for any purpose.

SEQUENCE LISTING

This application contains a Sequence Listing in computer readable form entitled "2021-01-21_01209-0008-00US_Sequence_Listing_ST25.txt," created Nov. 23, 2020, having a size of 808 KB, which is incorporated by reference herein.

FIELD

The present disclosure relates to Siglec-9 ECD fusion molecules and therapeutic uses of such fusion proteins.

BACKGROUND

Sialic acid-binding Ig-like lectin-9 (Siglec-9) is a type 1, immunoglobulin-like, transmembrane protein expressed on immune and hematopoietic cells, including immature and mature myeloid cells, such as monocytes, macrophages, dendritic cells, neutrophils, and microglia, as well as lymphoid cells, such as natural killer cells and subsets of T cells (Crocker et al. (2007) Nat Rev Immunol. 7:255-266; O'Reilly and Paulson (2009) Trends in Pharm. Sci. 30:5: 240-248; and Macauley et al. (2014) Nat. Rev. Imm 14: 653-666). Siglec-9 is a member of the Siglec family of lectins that bind sialic acid residues of glycoproteins and glycolipids. Potential ligands for Siglec proteins are gangliosides, which are glycolipids comprising a ceramide linked to a sialylated glycan. Diversity in the Siglec ligands is generated by the addition of other neutral sugars and sialic acid in different linkages, either branched or terminal, and modification of sialic acid itself.

Fourteen Siglec proteins have been identified in humans and nine in mice that are comprised of 2-17 extracellular Ig domains including an amino-terminal V-set Ig-like (IgV) domain that contains the sialic acid binding site. The IgV domain contains two aromatic residues and one arginine in a motif that is highly conserved in all Siglecs (Crocker et al. (2007) Nat Rev Immunol. 7:255-266; McMillan and Crocker (2008) Carbohydr Res. 343:2050-2056; Von Gunten and Bochner (2008) Ann NY Acad Sci. 1143:61-82; May et al. (1998) Mol Cell. 1:719-728; Crocker et al. (1999) Biochem J. 341:355-361; and Crocker and Varki (2001) Trends Immunol. 2:337-342). The ligand binding sites have been mapped by crystal structures with and without ligand bound (Attrill et al., (2006) J. Biol. Chem. 281 32774-32783; Alphey et al. (2003) J. Biol. Chem. 278:5 3372-3377; Varki et al., Glycobiology, 16 pp. 1R-27R; and May et al. (1998) Mol. Cell 1:5:719-728). Because cell membranes are rich in sialic acids, ligand binding by Siglecs can occur in cis and in trans, which affects their functional properties. Each Siglec has a distinct preference for binding the diverse types of sialylated glycans that are found on the surface of mammalian cells (Crocker et al. (2007) Nat Rev Immunol. 7:255-266; and Crocker et al. (2007) Nat Rev Immunol. 7:255-266).

Most Siglec proteins, including Siglec-9, are inhibitory receptors that contain one or more immunoreceptor tyrosine-based inhibitory motif (ITIM) sequences in their cytoplasmic domains. The inhibitory Siglecs act as negative regulators of immune function (Crocker et al. (2007) Nat Rev Immunol. 7:255-266; McMillan and Crocker (2008) Carbohydr Res. 343:2050-2056; and Von Gunten and Bochner (2008) Ann NY Acad Sci. 1143:61-82). Other Siglecs are activating receptors that contain immunoreceptor tyrosine-based activating motif (ITAM) sequences in their cytoplasmic domains. Those Siglecs act as positive regulators of immune function (Macauley S M. et al., (2014) *Nature Reviews Immunology* 14, 653-666).

The Siglec protein family plays a role in tumor pathogenesis. Many human tumors robustly upregulate sialic acid ligands that bind Siglec-9, which may enable immune evasion and cancer progression (Jandus et al. (2014) J. Clinic. Invest. 124:1810-1820). In contrast, tumors lacking sialic acid biosynthesis have reduced growth in mice (Stanczak et al. (2018) J Clin Invest. 128:4912-4923). Certain SNPs in Siglec-3, 7, 9 are associated with decreased risk of colorectal and lung cancer (Id.).

All references cited herein, including patent applications and publications, are hereby incorporated by reference in their entirety.

SUMMARY

The present disclosure is generally directed to Siglec-9 extracellular domain (ECD) fusion proteins and methods of treating cancer and neurodegenerative diseases using Siglec-9 ECD fusion proteins.

In some embodiments, an isolated polypeptide comprising a Siglec-9 IgV domain comprising an amino acid sequence selected from any one of SEQ ID NOs: 109-137 and 214-226. In some embodiments, the polypeptide comprises a Siglec-9 extracellular domain (ECD) comprising the Siglec-9 IgV domain, a C2 type 1 (C2T1) domain, and a C2 type 2 (C2T2) domain. In some embodiments, the polypeptide comprises an amino acid sequence selected from any one of SEQ ID NOs: 79-107 and 194-206. In some embodiments, the Siglec-9 IgV domain polypeptide does not comprise the membrane proximal region of Siglec-9, as shown in SEQ ID NO: 147 (MPR).

In some embodiments, the polypeptide further comprises an Fc domain. In some such embodiments, the Fc domain is located at the C-terminus of the polypeptide. In some embodiments, the Fc domain has an IgG1 isotype. In some embodiments, the Fc domain comprises an amino acid sequence selected from SEQ ID NOs: 142-144 and 234-239. In some embodiments, the Fc domain comprises the amino acid sequence of SEQ ID NO: 142 or 143. In some embodiments, the Fc domain comprises the amino acid sequence of SEQ ID NO: 142. In some embodiments, the isolated polypeptide comprises an Fc domain with a human IgG1 isotype that has (a) reduced binding to FcγRIII; (b) reduced antibody-dependent cellular cytotoxicity (ADCC) and/or reduced complement binding activity; (c) increased binding to FcγRIIa; or any combination of a), b), and/or c), relative to the IgG1 polypeptide of SEQ ID No: 142. In some embodiments, the Fc domain comprises the amino acid sequence of SEQ ID NO: 143. In some embodiments, the Fc domain has an IgG4 isotype. In some embodiments, the Fc domain comprises an amino acid sequence selected from SEQ ID NOs: 145-146.

In some embodiments, the polypeptide comprises an amino acid sequence selected from any one of SEQ ID NOs:

11-39, 148-160, and 168-170. In some embodiments, the polypeptide comprises an amino acid sequence selected from any one of SEQ ID NOs: 49-77, 171-183, and 191-193. In some embodiments, the polypeptide comprises an amino acid sequence selected from any one of SEQ ID NOs: 49-77 and 171-193, lacking its signal peptide.

In some embodiments, an isolated polypeptide comprising a Siglec-9 IgV domain is provided, which comprises the amino acid sequence of SEQ ID NO: 138. In some embodiments, an isolated polypeptide comprising a Siglec-9 IgV domain is provided, which comprises the amino acid sequence of SEQ ID NO: 138 further comprising an Fc domain, optionally located at the C-terminus of the polypeptide. Optionally, the Fc domain has a human IgG1 isotype. In some cases, the polypeptide further comprises a linker sequence. In some embodiments, the Fc domain comprises an amino acid sequence selected from SEQ ID NOs: 142-144. In some embodiments, the Fc domain comprises the amino acid sequence of SEQ ID NO: 142 or 143. In some embodiments, the polypeptide comprises the amino acid sequence of SEQ ID NO: 139. In some embodiments, the Fc domain has an IgG4 isotype. In some embodiments, the Fc domain comprises an amino acid sequence selected from SEQ ID NOs: 145-146.

In some embodiments, an isolated polypeptide comprising a Siglec-9 IgV domain is provided, which comprises the amino acid sequence of SEQ ID NO: 78 joined at its C-terminus to an Fc domain. In some embodiments, the polypeptide comprises the amino acid sequence of SEQ ID NO:10. In some embodiments, the polypeptide comprises the amino acid sequence of SEQ ID NO:227. In some embodiments, the Fc domain has an IgG1 isotype. In some embodiments, the Fc domain comprises an amino acid sequence selected from SEQ ID NOs: 142-144 and 234-239. In some embodiments, the Fc domain comprises the amino acid sequence of SEQ ID NO: 142 or 143. In some embodiments, the Fc domain comprises the amino acid sequence of SEQ ID NO: 142. In some embodiments, the isolated polypeptide comprises an Fc domain with a human IgG1 isotype that has (a) reduced binding to FcγRIII; (b) reduced antibody-dependent cellular cytotoxicity (ADCC) and/or reduced complement binding activity; (c) increased binding to FcγRIIa; or any combination of a), b), and/or c), relative to the IgG1 polypeptide of SEQ ID No: 142. In some embodiments, the Fc domain comprises the amino acid sequence of SEQ ID NO: 143. In some embodiments, the Fc domain has an IgG4 isotype. In some embodiments, the Fc domain comprises an amino acid sequence selected from SEQ ID NOs: 145-146. In some embodiments, an isolated polypeptide comprising a Siglec-9 IgV domain is provided, which comprises an amino acid sequence selected from any one of SEQ ID NOs: 45-48 and 228-233, lacking its associated signal peptide. In some embodiments, the polypeptide comprises an amino acid sequence selected from any one of SEQ ID NOs: 45-48 and 228-233. In some embodiments, the polypeptide comprises the amino acid sequence of SEQ ID NO: 45, lacking its associated signal peptide. In some embodiments, the polypeptide comprises the amino acid sequence of SEQ ID NO: 45. In some embodiments, the polypeptide comprises the amino acid sequence of SEQ ID NO: 48, lacking its associated signal peptide.

In some embodiments, an isolated polypeptide comprising a Siglec-9 IgV domain is provided, which comprises the amino acid sequence of any one of SEQ ID Nos: 207-213 and an Fc domain located at the C-terminus of the polypeptide. In some embodiments, the Fc domain has an IgG1 isotype. In some embodiments, the Fc domain comprises an amino acid sequence selected from SEQ ID NOs: 142-144 and 234-239. In some embodiments, the Fc domain comprises the amino acid sequence of SEQ ID NO: 142 or 143. In some embodiments, the Fc domain comprises the amino acid sequence of SEQ ID NO: 142. In some embodiments, the isolated polypeptide comprises an Fc domain with a human IgG1 isotype that has (a) reduced binding to FcγRIII; (b) reduced antibody-dependent cellular cytotoxicity (ADCC) and/or reduced complement binding activity; (c) increased binding to FcγRIIa; or any combination of a), b), and/or c), relative to the IgG1 polypeptide of SEQ ID No: 142. In some embodiments, the Fc domain comprises the amino acid sequence of SEQ ID NO: 143. In some embodiments, the Fc domain has an IgG4 isotype. In some embodiments, the Fc domain comprises an amino acid sequence selected from SEQ ID NOs: 145-146. In some embodiments, the polypeptide comprises an amino acid sequence selected from any one of SEQ ID Nos: 161-167. In some embodiments, the polypeptide comprises an amino acid sequence selected from any one of SEQ ID Nos: 184-190, lacking the signal peptide. In some embodiments, the polypeptide comprises an amino acid sequence selected from any one of SEQ ID Nos: 184-190.

In any of the embodiments of an isolated polypeptide comprising a Siglec-9 IgV domain provided herein, the polypeptide may bind sialic acid on the surface of cells. In some such embodiments, the cells are tumor cells. In some embodiments, the cells express FcR, e.g., FcRγIIA. In some embodiments, the cells are myeloid cells. In some embodiments, the myeloid cells are selected from monocytes, macrophages, dendritic cells, microglia, and myeloid-derived suppressor cells (MDSCs).

In any of the embodiments of an isolated polypeptide comprising a Siglec-9 IgV domain provided herein, the polypeptide:
a) blocks cell binding of any one or more Siglec family members selected from Siglec-3, Siglec-5, Siglec-7, Siglec-9, Siglec-10, and Siglec-15;
b) relieves MDSC-mediated suppression of T-cells, optionally as determined by measuring an increase in IFNγ expression or an increase in T-cell proliferation;
c) repolarizes MDSCs to a pro-inflammatory phenotype;
d) increases expression of CD86 on MDSCs, increases expression of CD11b on MDSCs, and/or decreases expression of CD163 on MDSCs;
e) repolarizes tumor macrophages away from an M2 phenotype;
f) reduces CD163+ and/or CD206+ macrophages;
g) induces expression of one or more chemokines selected from CCL3, CCL4, CCL5, CCL17, CXCL1, CXCL9, and IL-8 in MDSCs;
h) reduces myeloid cell recruitment into the tumor microenvironment;
i) binds to MDSCs with an affinity of less than 100 nM, less than 50 nM, less than 25 nM, less than 20 nM, less than 10 nM, less than 5 nM, less than 2 nM, 1-50 nM, 1-25 nM, 1-20 nM, 1-10 nM, 1-5 nM, or 1-2 nM; or
j) any one or more of (a) through (i).

In some such embodiments, the MDSCs are human MDSCs and/or the macrophages are human macrophages.

In some embodiments, an isolated nucleic acid is provided that comprises a nucleic acid sequence that encodes an isolated polypeptide comprising a Siglec-9 IgV domain provided herein. In some embodiments, the isolated nucleic acid encodes an amino acid sequence selected from any one of SEQ ID NOs: 48-77, 171-193, and 228-233. In some embodiments, the isolated nucleic acid encodes a polypeptide comprising an amino acid sequence selected from any one of SEQ ID NOs: 10-39, 148-170, and 227. In some embodiments, an expression vector is provided that comprises the isolated nucleic acid.

In some embodiments, a host cell is provided, which comprises an isolated nucleic acid or expression vector provided herein. In some embodiments, a host cell is provided, which expresses an isolated polypeptide comprising a Siglec-9 IgV domain provided herein. In some embodiments, a method of producing the polypeptide is provided, comprising culturing the host cell. In some such embodiments, the polypeptide is isolated.

In various embodiments, a pharmaceutical composition is provided, which comprises an isolated polypeptide comprising a Siglec-9 IgV domain provided herein and a pharmaceutically acceptable carrier. In some embodiments, the pharmaceutical composition may comprise (i) a polypeptide as described herein with its signal peptide, or (ii) a polypeptide lacking its signal peptide; and a pharmaceutically acceptable carrier.

In some embodiments, a method of treating cancer is provided, comprising administering to a subject with cancer an isolated polypeptide comprising a Siglec-9 IgV domain provided herein or a pharmaceutical composition comprising the polypeptide. In some embodiments, the cancer is a solid tumor associated with a tumor microenvironment comprising myeloid cells. In some embodiments, the cancer is selected from renal cell carcinoma, sarcoma, pancreatic cancer, glioblastoma, ovarian cancer, colorectal cancer, lung cancer, melanoma, bladder cancer, head and neck cancer, breast cancer and uterine cancer. In some embodiments, the method further comprises administering an antagonist of PD-1 or PD-L1, optionally wherein the antagonist of PD-1 or PD-L1 is an antibody that binds to PD-1 or PD-L1, respectively. In some embodiments, the method further comprises administering a chemotherapeutic agent.

In some embodiments, a method of treating a neurological or neurodegenerative disease is provided, comprising administering to a subject with a neurological or neurodegenerative disease an isolated polypeptide comprising a Siglec-9 IgV domain provided herein or a pharmaceutical composition comprising the polypeptide. In some embodiments, the neurological or neurodegenerative disease is characterized by dysfunctional or deficient microglia. In some embodiments, the neurological or neurodegenerative disease is selected from dementia, frontotemporal dementia, Alzheimer's disease, vascular dementia, and mild cognitive impairment, Parkinson's disease, amyotrophic lateral sclerosis (ALS), Huntington's disease, Taupathy disease, multiple sclerosis, immune-mediated neuropathies (such as neuropathic pain), Nasu-Hakola disease, pediatric-onset leukoencephalopathy and adult-onset leukoencephalopathy with axonal spheroids and pigmented glia (ALSP).

In some embodiments, a method of repolarizing myeloid-derived suppressor cells (MDSCs) to a pro-inflammatory phenotype in a subject is provided, comprising administering to a subject with a neurological or neurodegenerative disease an isolated polypeptide comprising a Siglec-9 IgV domain provided herein or a pharmaceutical composition comprising the polypeptide. In some such embodiments, the subject has cancer. In some embodiments, the cancer is a solid tumor associated with a tumor microenvironment comprising myeloid cells. In some embodiments, the cancer is selected from renal cell carcinoma, sarcoma, pancreatic cancer, glioblastoma, ovarian cancer, colorectal cancer, lung cancer, melanoma, bladder cancer, head and neck cancer, breast cancer and uterine cancer. In some cases, the cancer is metastatic. In some embodiments, the subject has a neurological or neurodegenerative disease. In some embodiments, the neurological or neurodegenerative disease is characterized by dysfunctional or deficient microglia. In some embodiments, the neurodegenerative disease is selected from dementia, frontotemporal dementia, Alzheimer's disease, vascular dementia, and mild cognitive impairment, Parkinson's disease, amyotrophic lateral sclerosis (ALS), Huntington's disease, Taupathy disease, multiple sclerosis, immune-mediated neuropathies (such as neuropathic pain), Nasu-Hakola disease, pediatric-onset leukoencephalopathy and adult-onset leukoencephalopathy with axonal spheroids and pigmented glia (ALSP).

In some embodiments, a method of repolarizing tumor macrophages away from an M2 phenotype in a subject having cancer is provided, the method administering to the subject an isolated polypeptide comprising a Siglec-9 IgV domain provided herein or a pharmaceutical composition comprising the polypeptide. In some embodiments, the cancer is a solid tumor associated with a tumor microenvironment comprising myeloid cells. In some embodiments, the cancer is selected from renal cell carcinoma, sarcoma, pancreatic cancer, glioblastoma, ovarian cancer, colorectal cancer, lung cancer, melanoma, bladder cancer, head and neck cancer, breast cancer and uterine cancer. In some cases, the cancer is metastatic.

In some embodiments, a method of activating myeloid cells in a subject is provided, the method administering to the subject an isolated polypeptide comprising a Siglec-9 IgV domain provided herein or a pharmaceutical composition comprising the polypeptide. In some cases, the myeloid cells are microglia. In some embodiments, the subject has cancer. In some embodiments, the cancer is a solid tumor associated with a tumor microenvironment comprising myeloid cells. In some embodiments, the cancer is selected from renal cell carcinoma, sarcoma, pancreatic cancer, glioblastoma, ovarian cancer, colorectal cancer, lung cancer, melanoma, bladder cancer, head and neck cancer, breast cancer and uterine cancer. In some cases, the cancer is metastatic. In some embodiments, the subject has a neurological or neurodegenerative disease. In some embodiments, the neurological or neurodegenerative disease is characterized by dysfunctional or deficient microglia. In some embodiments, the neurodegenerative disease is selected from dementia, frontotemporal dementia, Alzheimer's disease, vascular dementia, and mild cognitive impairment, Parkinson's disease, amyotrophic lateral sclerosis (ALS), Huntington's disease, Taupathy disease, multiple sclerosis, immune-mediated neuropathies (such as neuropathic pain), Nasu-Hakola disease, pediatric-onset leukoencephalopathy and adult-onset leukoencephalopathy with axonal spheroids and pigmented glia (ALSP).

BRIEF DESCRIPTION OF THE DRAWINGS

FIG. 1 shows surface expression of Siglec-9 on tumor infiltrating T cells, macrophages, and granulocytes, from a representative lung adenocarcinoma sample.

FIG. 2 shows the amino acid sequence of human Siglec-9 (SEQ ID NO: 1). From N-terminus to C-terminus, the signal peptide sequence is in bold; IgV ligand binding domain is underlined with the conserved Arg indicated in shaded bold); intervening sequence is in bold and italicized (AL-THR; SEQ ID NO: 3); C2 type 1 domain is italicized; intervening sequence is in bold and italicized (LNVSYP; SEQ ID NO: 4); and C2 type 2 domain is underlined and italicized. The ITIM motif (LQYASL; SEQ ID NO: 5) and SLAM-like (TEYSEI; SEQ ID NO: 6) motif are underlined and shaded. The transmembrane domain is predicted to occur from amino acids 349-369 of SEQ ID NO: 1.

FIG. 3 shows in silico calculated properties of certain engineered Siglec9-IgV variants at pH7.4, 100 mM concentration of NaCl, and 298 K, as described in Example 5.

FIG. 6 shows IFNγ expression by T cells co-cultured with MDSCs in the presence of increasing concentrations of S9.1-hIgG1 (S9-hIgG1) or S9.A-hIgG1 LALAPS (S9-hIgG1 LALAPS), as described in Example 11.

FIG. 7 shows CCL5 (top) and CCL17 (bottom) expression from MDSCs contacted with S9.A-hIgG1 (S9-hIgG1) or S9.A-hIgG1 NSLF (S9-hIgG1 NSLF), as described in Example 12.

FIG. 18 shows binding of various Siglec-9-Fc variants to A375 tumor cells and repolarization of myeloid-derived suppressor cells (MDSCs), as measured by CD86 upregulation and CD163 downregulation. FIG. 18 also shows the production yield and stability, as measured by melting temperature and percent monomer, for each variant.

FIG. 22A shows that binding of Siglec-9-hIgG1 (S9-hIgG1) NSLF (diamond) to MDSCs is in the low nM range. FIG. 22B shows that binding of Siglec-9-hIgG1 LALAPS, which is Fc silent, is about ~75 fold weaker than that of Siglec-9-hIgG1 NSLF. FIG. 22C shows binding of Siglec-9-hIgG1 (SEQ ID NO: 40) to reference cancer cell line A549, which does not express any Fcγ receptors. Binding curves for isotype controls (triangle) are also shown in each figure panel.

FIG. 24A compares the binding of the two molecules to blood monocytes based on mean fluorescence intensity (MFI). FIG. 24B shows the MFI associated with binding to several blood cell types.

FIG. 25A shows that the presence of MDSCs inhibited T-cell proliferation in two donor samples, which was restored in each sample by Siglec-9-hIgG1 NSLF. FIG. 25B provides a dose-response curve to determine the EC50 of Siglec-9-hIgG1 NSLF in restoring T-cell proliferation, which was about 1-2 nM.

Figure 27:
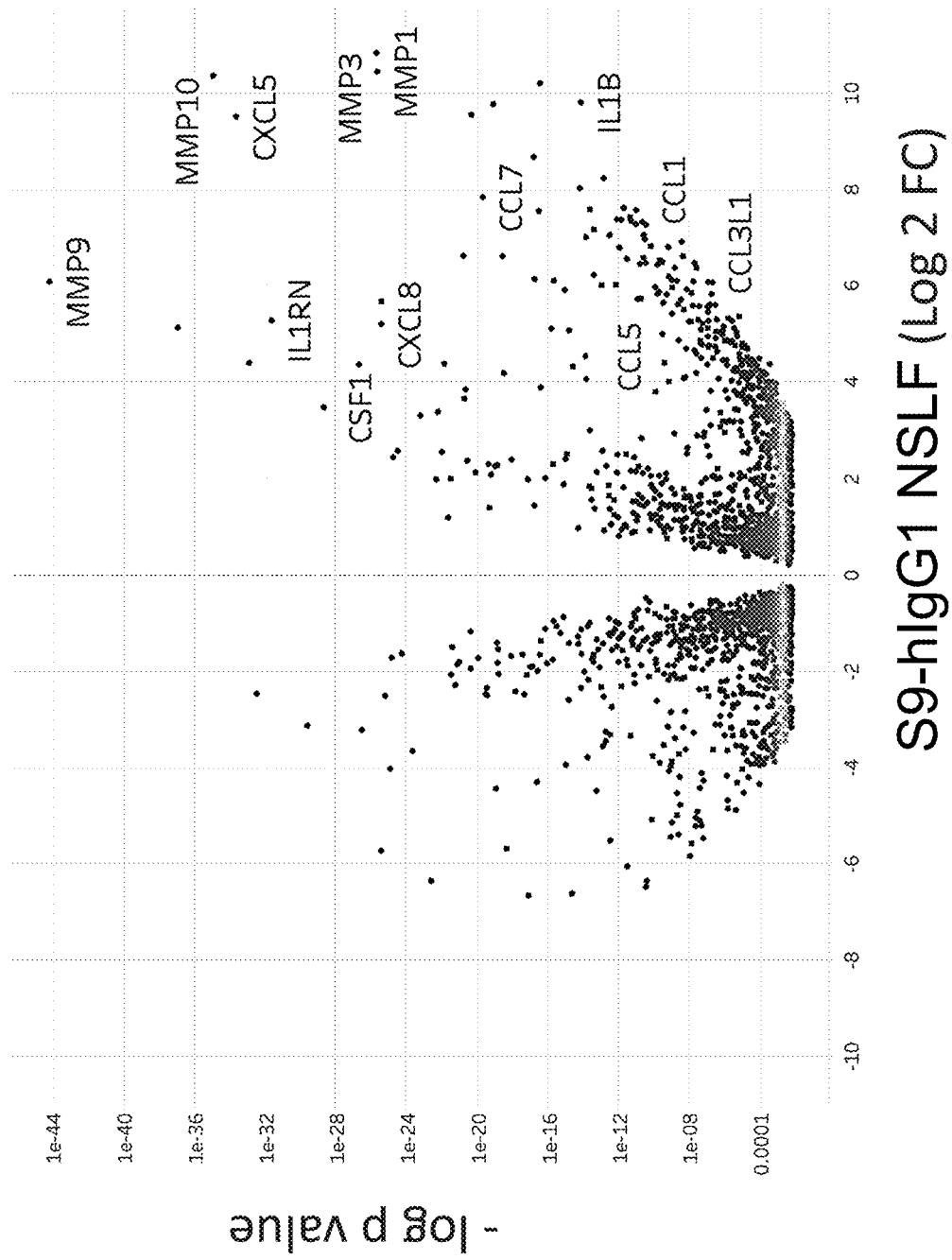

FIG. 27 shows that Siglec-9-hIgG1 NSLF induces a robust gene expression profile when incubated with MDSCs, and this profile is consistent with macrophage repolarization.

Figure 28A:
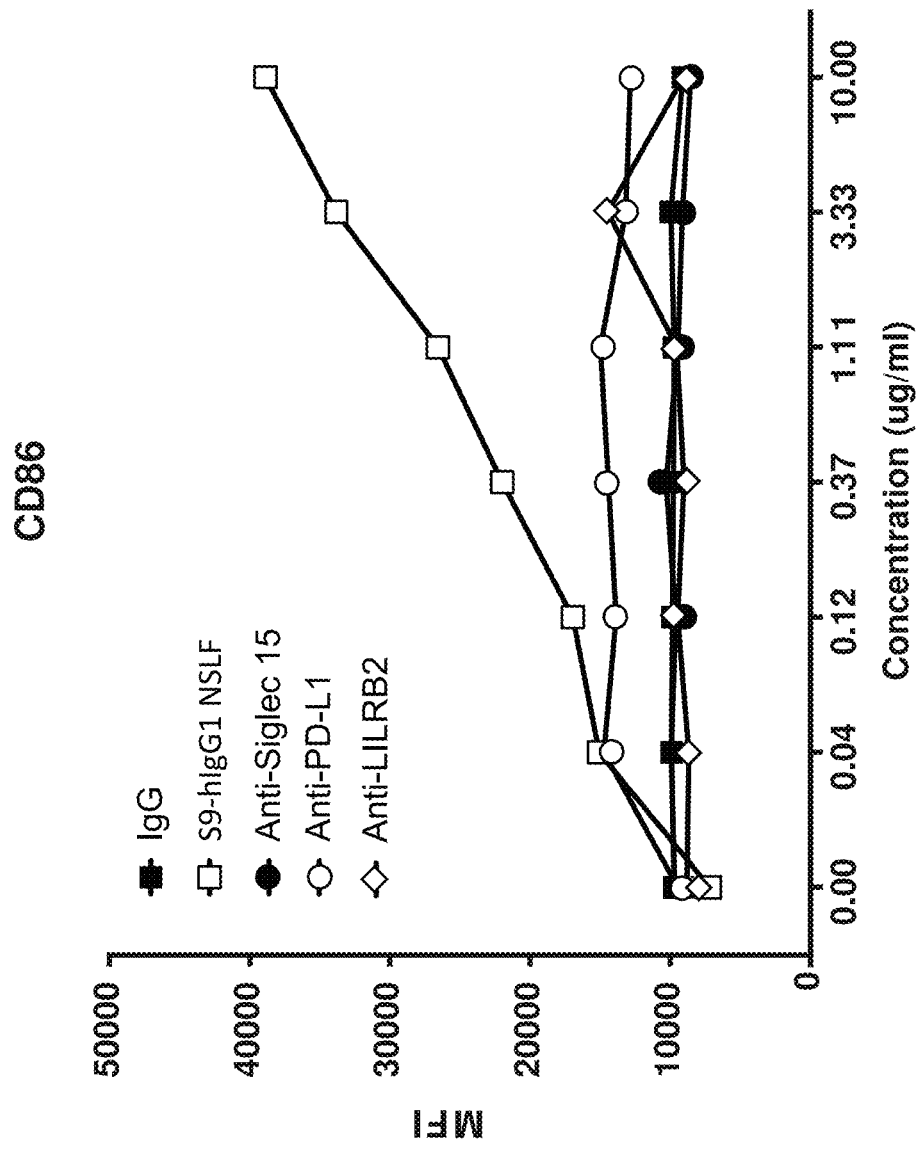
Figure 28B:
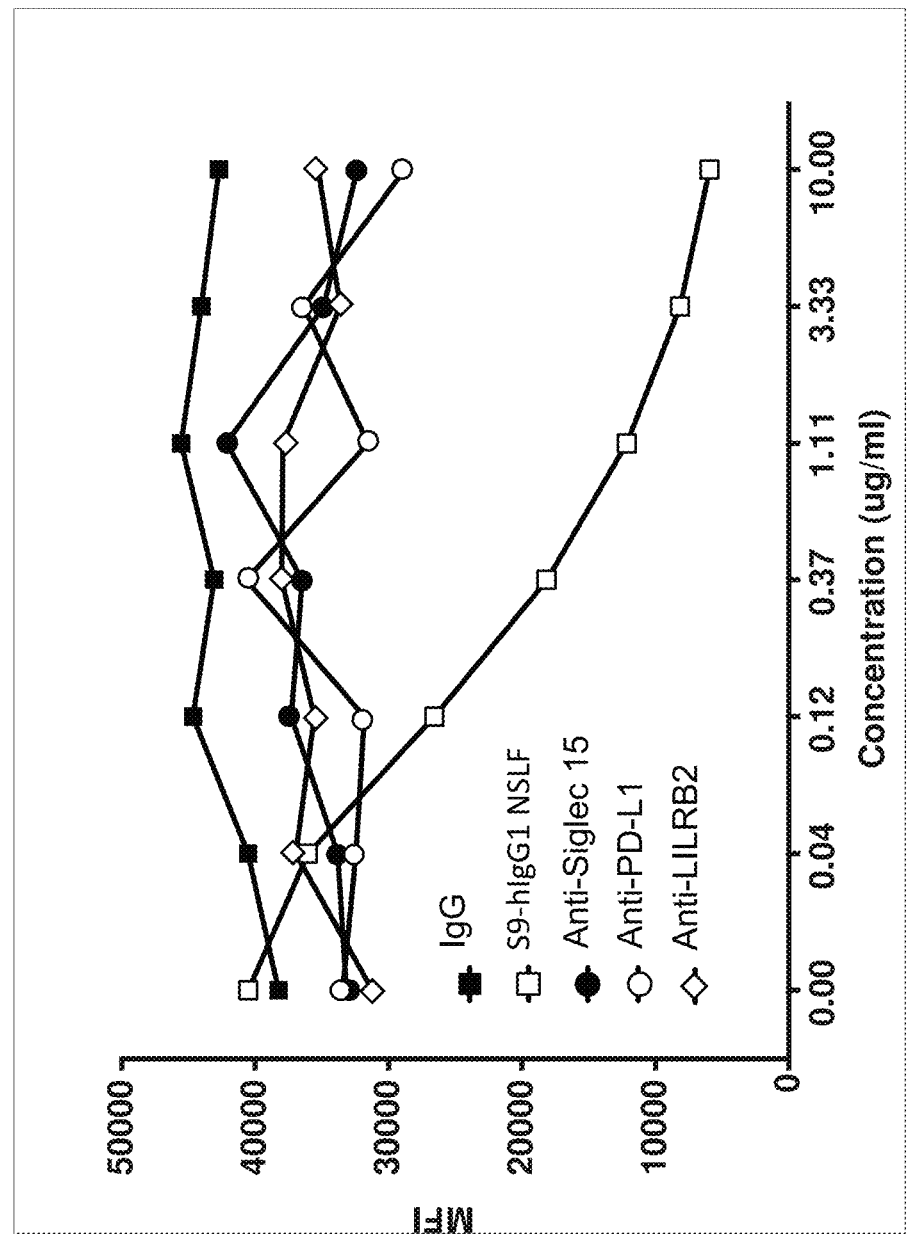

FIG. 28A shows that Siglec-9-hIgG1 NSLF causes an increase in M1 polarization (upregulation of CD86) compared to anti-Siglec 15, anti-PD-L1, and anti-LILRB2 antibodies. FIG. 28B shows that Siglec-9-hIgG1 NSLF causes a decrease in M2 polarization (downregulation of CD206) compared to anti-Siglec 15, anti-PD-L1, and anti-LILRB2 antibodies.

Figure 29:
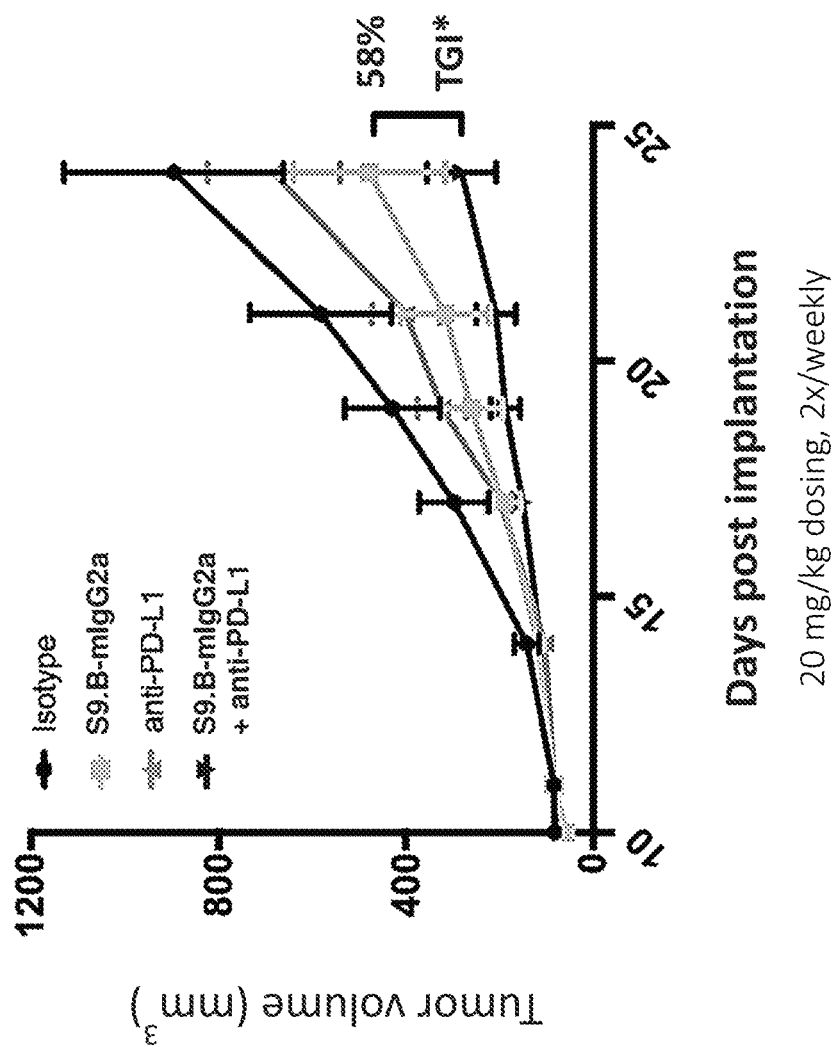

FIG. 29 shows that Siglec-9-mIgG2a in combination with an anti-PD-L1 antibody decreases growth of implanted E0771 breast tumor cells in mice to a greater extent than an isotype control or either of Siglec-9-mIgG2a or anti-PD-L1 antibodies alone.

Figures 30A, 30B:
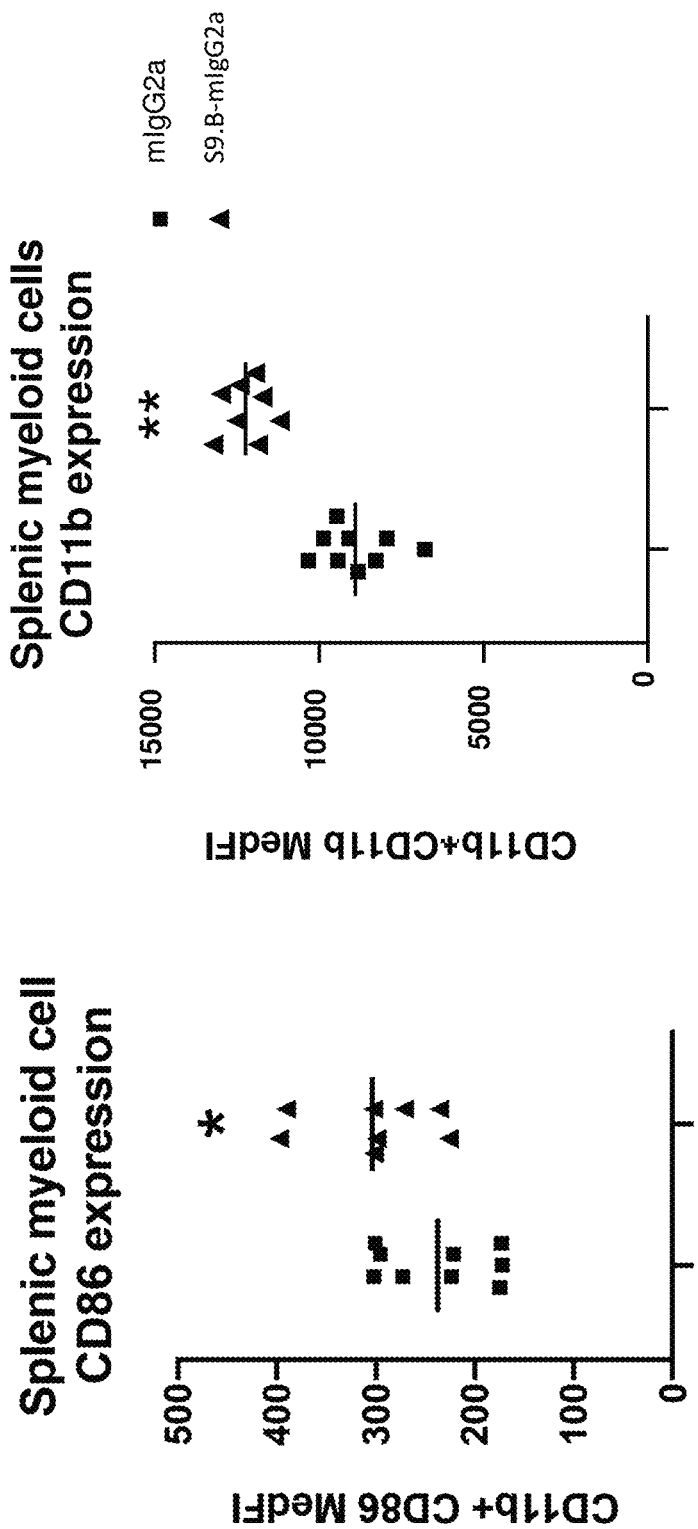

FIG. 30A and FIG. 30B show the impact of Siglec-9-mIgG2a (upward triangles) or isotype control (mIgG2a) (squares) on CD86 (FIG. 30A) or CD11b (FIG. 30B) expression from splenic myeloid cells.

FIG. 31 shows the properties of certain additional Siglec-9-Fc variants.

Figure 32A:
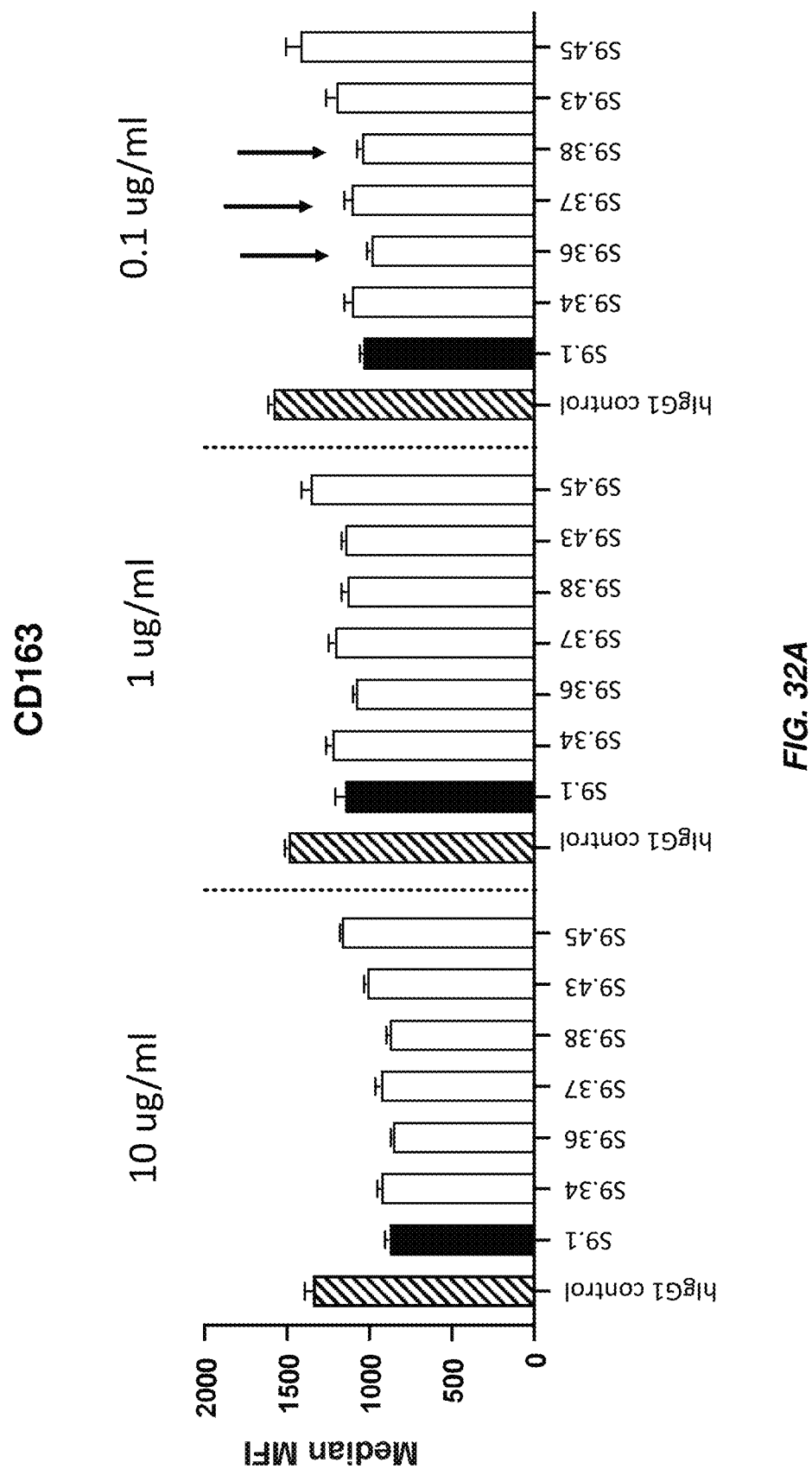
Figure 32B:
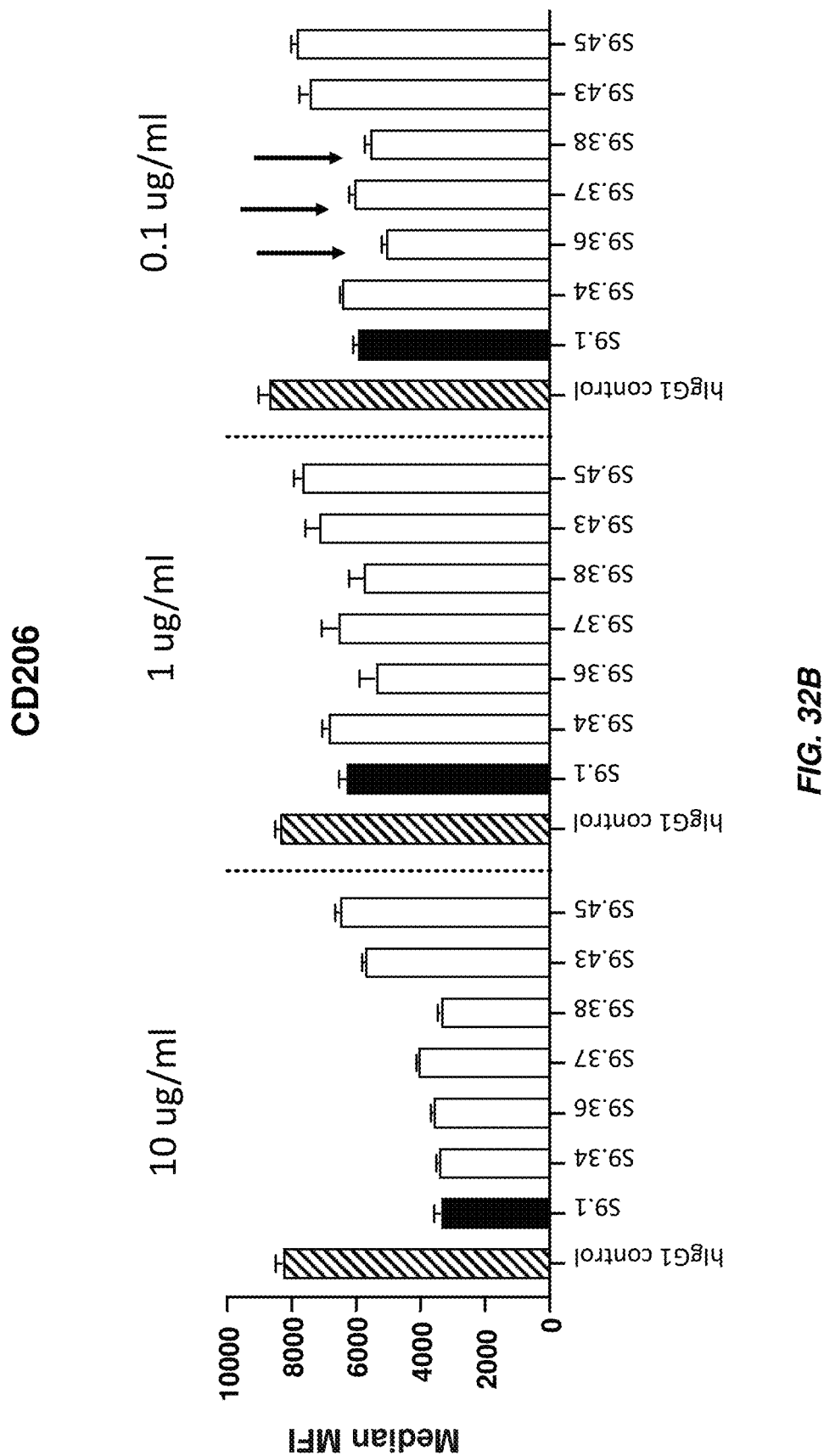
Figure 32C:
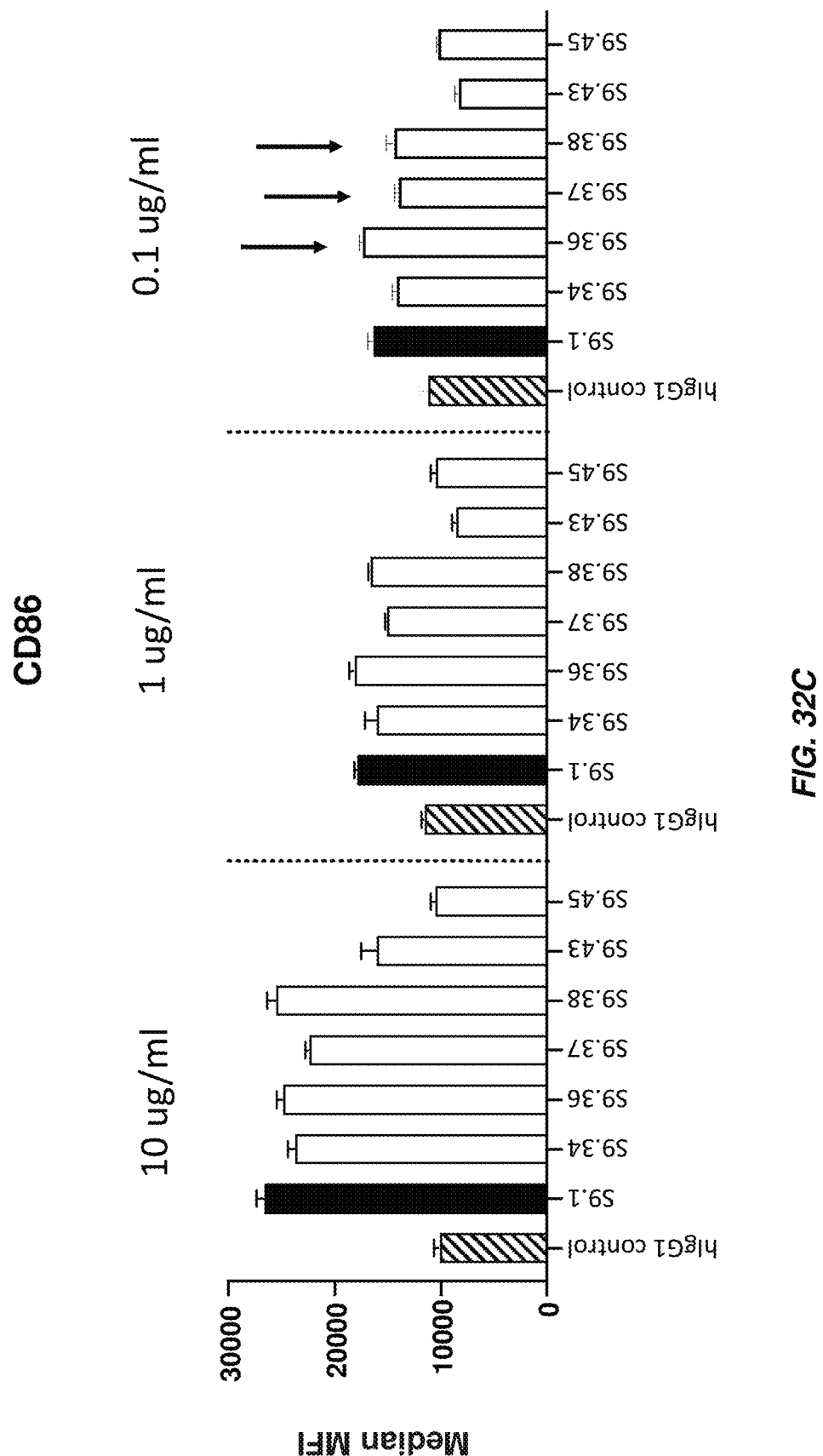

FIG. 32A-32C show that variants 59.36, 59.37 and 59.38 behaved comparably to Siglec-9-Fc-hIgG1 (black bars, second from left), showing decreased CD163 (FIG. 32A) and CD206 (FIG. 32B) and increased CD86 (FIG. 32C) expression in comparison to an isotype control (hatched bars at far left).

Figure 33:
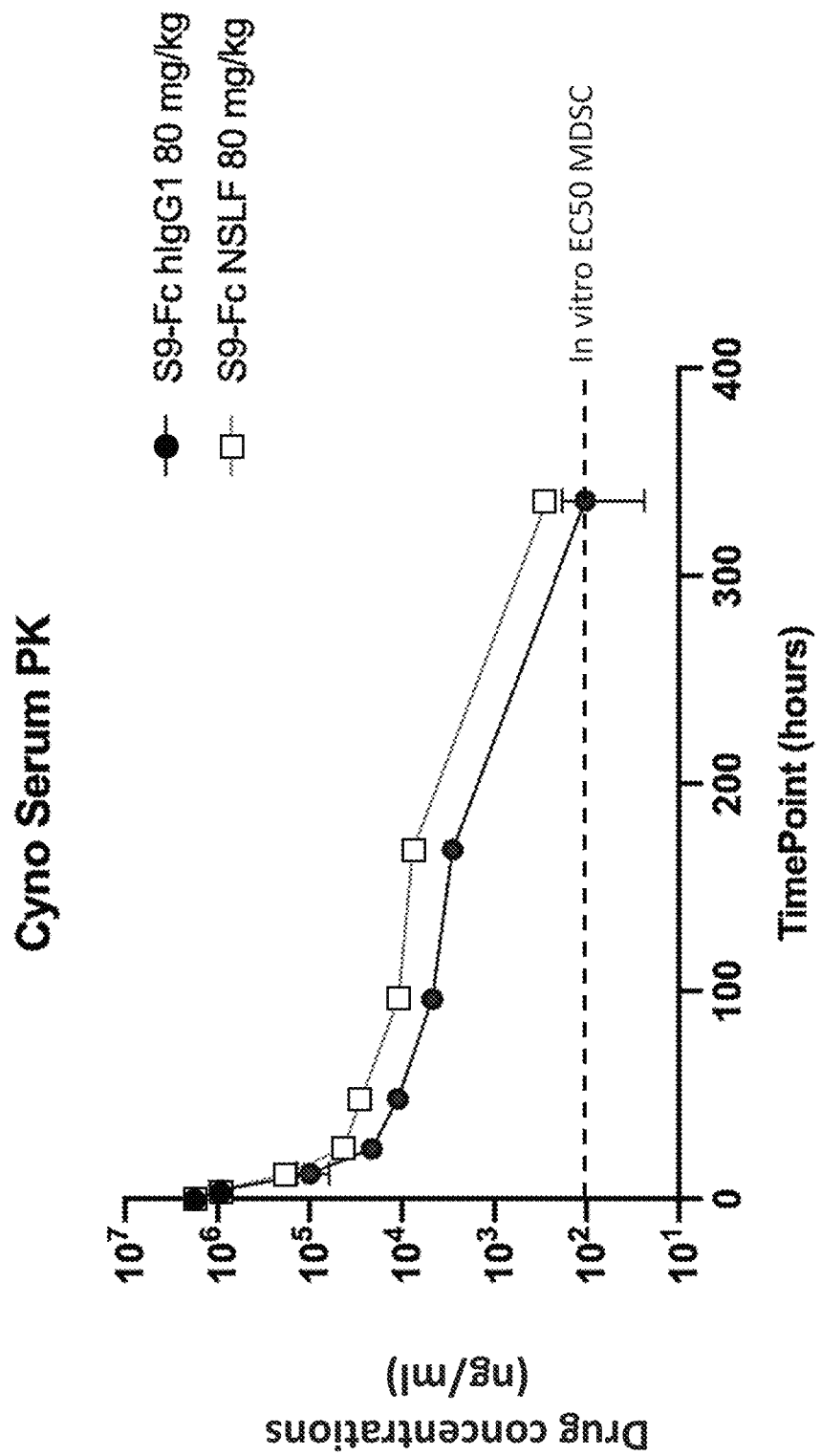

FIG. 33 shows mean concentration-time profiles of Sigled-9-hIgG1 (filled circles) and Siglec-9-hIgG1 NSLF (open squares) in sera of cynomolgus monkeys.

FIG. 34 shows the kinetic profiles of several Siglec-9-Fc variants after IV bolus injection to Siglec 3/7/9 BAC transgenic mice.

It is to be understood that one, some, or all of the properties of the various embodiments described herein may be combined to form other embodiments of the present invention. These and other aspects of the invention will become apparent to one of skill in the art. These and other embodiments of the invention are further described by the detailed description that follows.

DETAILED DESCRIPTION

Provided herein are polypeptides comprising the extracellular domain of Siglec-9 and a fusion partner, e.g., an Fc domain. Siglec-9 ECD-Fc fusion molecules unexpectedly show cooperative binding to myeloid cells, resulting in potent activation of these innate immune cells, compared to antibodies against Siglec-9 or other Siglec proteins. Such activation is useful, e.g., in the treatment of cancer, neurodegenerative disorders, and other diseases and disorders in which the immune system may otherwise be inappropriately suppressed. Further provided herein are polypeptides comprising variants of the Siglec-9 extracellular domain, and in the IgV domain in particular, which are engineered to improve stability, solubility, ligand binding and/or other properties. Such variants are useful in fusion molecules for activating the immune response as described above. Other inventions and embodiments are further described herein.

Definitions

The terms "Siglec-9 extracellular domain" and "Siglec-9 ECD" refer to an extracellular domain polypeptide of Siglec-9 or a fragment thereof that binds sialic acid on the surface of cells. The terms include natural and engineered variants thereof. In some embodiments, a Siglec-9 ECD comprises the IgV domain of Siglec-9. In some embodiments, a Siglec-9 ECD comprises the IgV domain and the C2 type 1 (C2T1) domain and the C2 type 2 (C2T2) domain of Siglec-9. Nonlimiting exemplary Siglec-9 ECDs are shown in SEQ ID NOs: 78-138.

The term "Siglec-9 ECD fusion molecule" refers to a molecule comprising a Siglec-9 ECD and a covalently-attached fusion partner, such as an Fc domain, albumin, or polyethylene glycol (PEG). In some embodiments, the fusion partner is attached to the C-terminus of the Siglec-9 ECD. A Siglec-9 ECD fusion molecule in which the fusion partner is an Fc domain may also be referred to herein as a "Siglec-9 ECD-Fc fusion molecule," a "Siglec-9 ECD-Fc," or a "Siglec-9-Fc." Nonlimiting exemplary Siglec-9 ECD-Fc fusion molecules are shown in the amino acid sequences of SEQ ID NOs: 10-77 and 139, including those sequences with or without their associated signal peptides.

The term "specific binding" or "specifically binds" or is "specific for" a target moiety means binding that is measurably different from a non-specific interaction. Specific binding can be measured, for example, by determining binding of a test molecule for the target moiety compared to binding of the test molecule for a control moiety. The test molecule specifically binds the target moiety if the binding affinity for the target moiety is at least 2-fold, or at least 3-fold, or at least 5-fold, or at least 10-fold stronger than the binding affinity for the control moiety. For the avoidance of doubt, specific binding does not require that a test molecule does not bind any other moieties.

An "amino acid modification" at a specified position, e.g., of a Siglec-9 ECD of the present disclosure, refers to the substitution or deletion of the specified residue, or the insertion of at least one amino acid residue adjacent the specified residue. Insertion "adjacent" to a specified residue means insertion within one to two residues thereof. The insertion may be N-terminal or C-terminal to the specified residue. The preferred amino acid modification herein is a substitution.

The term "Fc region" herein is used to mean a C-terminal region of an immunoglobulin heavy chain, including native sequence Fc regions and variant Fc regions. Although the boundaries of the Fc region of an immunoglobulin heavy chain might vary, the human IgG heavy chain Fc region is generally defined as including a polypeptide from an amino acid residue at position Cys226 or from Pro230, to the carboxyl-terminus thereof. The C-terminal lysine (residue 447 according to the EU numbering system) of the Fc region may be removed, for example, during production or purification of an Fc region-containing polypeptide, or by recombinantly engineering the nucleic acid encoding the Fc region-containing polypeptide. Suitable native-sequence Fc regions for use in the present disclosure include human IgG1, IgG2, IgG3 and IgG4.

A "native sequence Fc region" comprises an amino acid sequence identical to the amino acid sequence of an Fc region found in nature. Native sequence human Fc regions include a native sequence human IgG1 Fc region (non-A and A allotypes); a native sequence human IgG2 Fc region; a native sequence human IgG3 Fc region; and a native sequence human IgG4 Fc region as well as naturally occurring variants thereof.

A "variant Fc region" comprises an amino acid sequence which differs from that of a native sequence Fc region by virtue of at least one amino acid modification, preferably one or more amino acid substitution(s). Preferably, the variant Fc region has at least one amino acid substitution compared to a native sequence Fc region, e.g. from about one to about ten amino acid substitutions, and preferably from about one to about five amino acid substitutions in a native sequence Fc region. The variant Fc region herein will preferably possess at least about 80% homology with a native sequence Fc region, and most preferably at least about 90% homology therewith, more preferably at least about 95% homology therewith.

"Fc receptor" or "FcR" describes a receptor that binds to the Fc region. The preferred FcR is a native sequence human FcR. Moreover, a preferred FcR is one which binds an IgG Fc region (a gamma receptor) and includes receptors of the FcγRI, FcγRII, and FcγRIII subclasses, including allelic variants and alternatively spliced forms of these receptors, FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif ("ITAM") in its cytoplasmic domain Inhibiting receptor FcγRIIB contains an immunoreceptor tyrosine-based inhibition motif ("ITIM") in its cytoplasmic domain. Other FcRs are encompassed by the term "FcR" herein. FcRs can also increase the serum half-life of molecules that comprise Fc regions.

Binding to FcR in vivo and serum half-life of human FcR high-affinity binding polypeptides can be assayed, e.g., in transgenic mice or transfected human cell lines expressing human FcR, or in primates to which the polypeptides having a variant Fc region are administered. WO 2004/42072 (Presta) describes Fc region variants with improved or diminished binding to FcRs. See also, e.g., Shields et al., J. Biol. Chem. 9(2):6591-6604 (2001).

As used herein, "percent (%) amino acid sequence identity" and "homology" with respect to a reference polypeptide sequence refers to the percentage of amino acid residues in a query sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or MEGALIGN™ (DNASTAR) software. Those skilled in the art can determine appropriate parameters for measuring alignment, including any algorithms known in the art needed to achieve maximal alignment over the full-length of the sequences being compared.

An "isolated" nucleic acid molecule encoding a polypeptide, such as a polypeptide comprising a Siglec-9 ECD of the present disclosure, is a nucleic acid molecule that is identified and separated from at least one contaminant molecule with which it is ordinarily associated in the environment in which it was produced. Preferably, the isolated nucleic acid is free of association with most or substantially all components associated with the production environment. The isolated nucleic acid molecules encoding the polypeptides herein are distinguished from nucleic acids existing naturally in cells.

The term "vector," as used herein, is intended to refer to a nucleic acid molecule capable of transporting another nucleic acid to which it has been linked. One type of vector is a "plasmid," which refers to a circular double stranded DNA into which additional DNA segments may be ligated. Another type of vector is a phage vector. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors," or simply, "expression vectors." In general, expression vectors of utility in recombinant DNA techniques are often in the form of plasmids. In the present specification, "plasmid" and "vector" may be used interchangeably as the plasmid is the most commonly used form of vector.

"Polynucleotide," or "nucleic acid," as used interchangeably herein, refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase or by a synthetic reaction.

A "host cell" includes an individual cell or cell culture that can contain or contains a vector(s) or other exogenous nucleic acid, e.g., that incorporates a polynucleotide insert(s). In some embodiments, the vector or other exogenous nucleic acid is incorporated into the genome of the host cell. Host cells include progeny of a single host cell, and the progeny may not necessarily be completely identical (in morphology or in genomic DNA complement) to the original parent cell due to natural, accidental, or deliberate mutation. A host cell includes cells comprising (e.g., transfected with) a polynucleotide(s) of this invention.

"Carriers" as used herein include pharmaceutically acceptable carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

As used herein, the term "preventing" includes providing prophylaxis with respect to occurrence or recurrence of a particular disease, disorder, or condition in an individual. An individual may be predisposed to, susceptible to a particular disease, disorder, or condition, or at risk of developing such a disease, disorder, or condition, but has not yet been diagnosed with the disease, disorder, or condition.

As used herein, an individual "at risk" of developing a particular disease, disorder, or condition may or may not have detectable disease or symptoms of disease, and may or may not have displayed detectable disease or symptoms of disease prior to the treatment methods described herein. "At risk" denotes that an individual has one or more risk factors, which are measurable parameters that correlate with development of a particular disease, disorder, or condition, as known in the art. An individual having one or more of these risk factors has a higher probability of developing a particular disease, disorder, or condition than an individual without one or more of these risk factors.

As used herein, the terms "treat," "treatment," "treating," and the like refer to clinical intervention designed to alter the natural course of a clinical pathology in the individual being treated. Desirable effects of treatment include decreasing the rate of progression, ameliorating or palliating the pathological state, remission or improved prognosis, and/or alleviating or lessening the symptoms of a particular disease, disorder, or condition. An individual is successfully "treated", for example, if one or more symptoms associated with a particular disease, disorder, or condition are mitigated or eliminated. In certain embodiments, a patient is successfully "treated" for cancer according to the methods of the present invention if the patient shows one or more of the following: a reduction in the number of or complete absence of cancer cells; a reduction in the tumor size; inhibition of or an absence of cancer cell infiltration into peripheral organs including, for example, the spread of cancer into soft tissue and bone; inhibition of or an absence of tumor metastasis; inhibition of or an absence of tumor growth; relief of one or more symptoms associated with the specific cancer; reduced morbidity and mortality; improvement in quality of life; reduction in tumorigenicity, tumorigenic frequency, or tumorigenic capacity, of a tumor; reduction in the number or frequency of cancer stem cells in a tumor; differentiation of tumorigenic cells to a non-tumorigenic state; increased progression-free survival (PFS), disease-free survival (DFS), overall survival (OS), complete response (CR), partial response (PR), or stable disease (SD); a decrease in progressive disease (PD); reduced time to progression (TTP); or any combination thereof.

The terms "administer," "administering," "administration," and the like refer to methods that may be used to enable delivery of a therapeutic agent such as a Siglec-9 ECD fusion molecule (e.g., a Siglec-9 ECD-Fc fusion molecule). Administration techniques that can be employed with the agents and methods described herein are found in e.g., Goodman and Gilman, The Pharmacological Basis of Therapeutics, current edition, Pergamon; and Remington's, Pharmaceutical Sciences, current edition, Mack Publishing Co., Easton, Pa.

An "effective amount" refers to at least an amount effective, at dosages and for periods of time necessary, to achieve the desired therapeutic or prophylactic result. An effective amount can be provided in one or more administrations. An effective amount herein may vary according to factors such as the disease state, age, sex, and weight of the individual, and the ability of the treatment to elicit a desired response in the individual. An effective amount is also one in which any toxic or detrimental effects of the treatment are outweighed by the therapeutically beneficial effects. For prophylactic use, beneficial or desired results include results such as eliminating or reducing the risk, lessening the severity, or delaying the onset of the disease, including biochemical, histological and/or behavioral symptoms of the disease, its complications and intermediate pathological phenotypes presenting during development of the disease. For therapeutic use, beneficial or desired results include clinical results such as decreasing one or more symptoms resulting from the disease, increasing the quality of life of those suffering from the disease, decreasing the dose of other medications required to treat the disease, enhancing effect of another medication such as via targeting, delaying the progression of the disease, and/or prolonging survival. An effective amount of drug, compound, or pharmaceutical composition is an amount sufficient to accomplish prophylactic or therapeutic treatment either directly or indirectly. As is understood in the clinical context, an effective amount of a drug, compound, or pharmaceutical composition may or may not be achieved in conjunction with another drug, compound, or pharmaceutical composition. Thus, an "effective amount" may be considered in the context of administering one or more therapeutic agents, and a single agent may be considered to be given in an effective amount if, in conjunction with one or more other agents, a desirable result may be or is achieved.

An "individual" or "subject" or "patient" for purposes of treatment, prevention, or reduction of risk refers to any animal classified as a mammal, including humans, domestic and farm animals, and zoo, sport, or pet animals, such as dogs, horses, rabbits, cattle, pigs, hamsters, gerbils, mice, ferrets, rats, cats, and the like. In some embodiments, the individual is human.

The terms "cancer" and "cancerous" refer to or describe the physiological condition in mammals in which a population of cells are characterized by unregulated cell growth. The cancer may be a primary tumor or may be advanced or metastatic cancer. A "refractory" cancer is one that progresses even though an anti-tumor treatment has been administered to the cancer patient. A "recurrent" cancer, or a cancer that has "recurred," is one that has regrown, either at the initial site or at a distant site, after a response to initial therapy. A "relapsed" patient is one who has signs or symptoms of cancer after remission. Optionally, the patient has relapsed after adjuvant or neoadjuvant therapy.

As used herein, administration of an agent or composition "in conjunction" or "in combination" with another agent or composition includes simultaneous administration and/or administration at different times. Administration in conjunction also encompasses administration as a co-formulation or administration as separate compositions, including at different dosing frequencies or intervals, and using the same route of administration or different routes of administration. In some embodiments, administration in conjunction means administration as a part of the same treatment regimen. In some embodiments, administration of an agent in combination with another agent results in "synergy" or a "synergistic effect," i.e., the effect achieved when the agents are used together is greater than the sum of the effects that result from using the agents separately. In some embodiments, administration of an agent in combination with another agent results in an "additive" effect, i.e., the effect achieved when the agents are used together is equal to the sum of the effects that result from using the agents separately.

The term "about" as used herein refers to the usual error range for the respective value readily known to the skilled person in this technical field. Reference to "about" a value or parameter herein includes (and describes) embodiments that are directed to that value or parameter per se.

As used herein and in the appended claims, the singular forms "a," "an," and "the" include plural reference unless the context clearly indicates otherwise.

It is understood that aspect and embodiments of the present disclosure described herein include "comprising," "consisting," and "consisting essentially of" aspects and embodiments.

Polypeptides Comprising Siglec-9 Extracellular Domains

In some embodiments, a Siglec-9 ECD or Siglec-9 ECD fusion molecule according to any of the embodiments herein may incorporate any of the features, singly or in combination, as described herein.

Provided herein are polypeptides comprising a Siglec-9 IgV domain. In certain embodiments, the Siglec-9 IgV domain comprises amino acids 20-140 of human Siglec-9 of SEQ ID NO: 1. See FIG. 2. As shown in Example 2 herein, the IgV domain of Siglec-9 is sufficient for binding to sialic acid on the surface of cells. In some embodiments, polypeptides are provided that comprise a Siglec-9 extracellular domain (ECD) comprising the IgV domain, the C2 type 1 (C2T1) domain, and the C2 type 2 (C2T2) domain. The Siglec-9 C2T1 domain comprises amino acids 146-229 of human Siglec-9 of SEQ ID NO: 1, and the Siglec-9 C2T2 domain comprises amino acids 236-336 of human Siglec-9 of SEQ ID NO: 1. In some embodiments, a Siglec-9 ECD comprises amino acids 20-336 of SEQ ID NO: 1, optionally with one or more amino acid modifications. In some embodiments, a Siglec-9 ECD comprises amino acids 20-336 of SEQ ID NO: 1, optionally with one or more amino acid modifications, and optionally with one to five amino acid deletions or additions on the N-terminus and/or C-terminus. In some embodiments, the Siglec-9 ECD may comprise the IgV, C2T1 and C2T2 domains, but may lack, for example, the last one, two, three, four, five, six, seven, eight, nine, ten, eleven or twelve C-terminal (membrane proximal) amino acids of the ECD. The twelve C-terminal (membrane proximal) amino acids of the ECD are shown in SEQ ID NO: 147. An example is SEQ ID NO: 78, for instance, which comprises the IgV, C2T1 and C2T2 domains and which lacks the C-terminal membrane proximal region.

In some embodiments, a polypeptide comprises a Siglec-9 IgV domain comprising one or more amino acid substitutions that improve stability of the polypeptide, improve the binding affinity for sialic acid, improve the function of the polypeptide, improve the pharmacokinetic properties of the polypeptide (e.g., half-life, Cmax, or AUC), or any combination of the foregoing. In some embodiments, a polypeptide comprises a Siglec-9 IgV domain having an amino acid sequence selected from any one of SEQ ID NOs: 108-137 and 214-226. In some embodiments, a polypeptide comprises a Siglec-9 IgV domain having an amino acid sequence selected from any one of SEQ ID NOs: 109-137 and 214-226. In some embodiments, a polypeptide comprises a Siglec-9 IgV domain having an amino acid sequence selected from any one of SEQ ID NOs: 108-137 and 214-226, optionally with one to five amino acid deletions or additions on the N-terminus and/or C-terminus. In some embodiments, a polypeptide comprises a Siglec-9 IgV domain having an amino acid sequence selected from any one of SEQ ID NOs: 109-137 and 214-226, optionally with one to five amino acid deletions or additions on the N-terminus and/or C-terminus. In some embodiments, a polypeptide comprises a Siglec-9 ECD with one or more substitutions C-terminal to the IgV domain. For example, in some embodiments the polypeptide comprises a Siglec-9 ECD of any one of SEQ ID Nos: 207-213. The sequence table below depicts the sequences corresponding to SEQ ID Nos listed herein. In many cases, locations of amino acid substitutions are shown in the table, such as by underlining, or by bolding and underlining, mutated residues.

In some embodiments, a polypeptide comprises a Siglec-9 ECD comprising one or more amino acid substitutions that improve stability of the polypeptide, improve the binding affinity for sialic acid, improve the function of the polypeptide, improve the pharmacokinetic properties of the polypeptide, or any combination of the foregoing. In some embodiments, a polypeptide comprises a Siglec-9 ECD having an amino acid sequence selected from any one of SEQ ID NOs: 78-107, 138, and 194-206. In some embodiments, a polypeptide comprises a Siglec-9 ECD having an amino acid sequence selected from any one of SEQ ID NOs: 78-107, 138, 194-206, optionally with one to five amino acid deletions or additions on the N-terminus and/or C-terminus.

In any of the embodiments provided herein, a polypeptide may further comprise a fusion partner. Nonlimiting exemplary fusion partners include Fc domains, albumin, and polyethylene glycol (PEG). In some embodiments, the fusion partner is covalently linked to the C-terminus of a Siglec-9 ECD. In some aspects, the fusion partner comprises an Fc domain. In some embodiments, a polypeptide comprising a Siglec-9 ECD and an Fc domain is provided herein, wherein the Fc domain is optionally fused to the C-terminus of the Siglec-9 ECD with or without an intervening linker sequence. A "linker sequence" as used herein refers to a polypeptide sequence not found in a native Siglec-9 ECD or its fusion partner (e.g., an Fc domain), wherein such polypeptide sequence is disposed between the Siglec-9 ECD and its fusion partner. In some embodiments, a linker sequence may be between about 4 and 25 amino acids. In some embodiments, the Fc domain is fused to the C-terminus without a linker sequence. In various embodiments, a polypeptide comprises a Siglec-9 ECD and an IgG1 Fc domain, e.g., the IgG1 Fc domain of SEQ ID NO: 142. In some embodiments, a polypeptide comprising a Siglec-9 ECD comprises an IgG1 Fc domain comprising NSLF substitutions, e.g., SEQ ID NO: 143. In some embodiments, a polypeptide comprising a Siglec-9 ECD comprises an IgG1 Fc domain comprising a K322A substitution, e.g., SEQ ID NO: 144. In some embodiments, a polypeptide comprising a Siglec-9 ECD comprises an IgG4 Fc domain or an IgG4 Fc domain comprising a S228P substitution, e.g., as shown in SEQ ID NOs: 145 or 146, respectively.

In some embodiments, a Siglec-9 ECD fusion molecule comprises an amino acid sequence selected from any one of SEQ ID NOs: 10-39, 148-160, and 168-170. In some embodiments, a Siglec-9 ECD fusion molecule comprises an amino acid sequence selected from any one of SEQ ID NOs: 40-77, 171-183, and 191-193, optionally lacking the signal sequence.

In some embodiments, a Siglec-9 ECD or a Siglec-9 ECD IgV domain of a Siglec-9 ECD fusion molecule comprises an amino acid sequence selected from any one of SEQ ID Nos: 109-137 and 214-226. In some cases, the Siglec-9 ECD comprises the IgV, C2T1, and C2T2 domains. In some embodiments, the Siglec-9 ECD lacks the membrane proximal region sequence of SEQ ID NO: 147 (MPR). In some embodiments, the Siglec-9 ECD comprises the IgV, C2T1, and C2T2 domains and lacks the MPR. In some embodiments, a Siglec-9 ECD comprises an amino acid sequence selected from any one of SEQ ID Nos: 79-107 and 194-206. In some embodiments, a Siglec-9 ECD comprises an amino acid sequence selected from any one of SEQ ID Nos: 79-107 and 194-206 and lacks the MPR of SEQ ID NO: 147. In some embodiments, a Siglec-9 ECD consists of an amino acid sequence selected from any one of SEQ ID Nos: 79-107 and 194-206. In some aspects, the Siglec-9 ECD is part of a Siglec-9 ECD fusion molecule, comprising the ECD and a fusion partner. In some embodiments, the fusion partner is an Fc, albumin, or PEG. In some embodiments, the fusion partner is an Fc. In some embodiments, the fusion partner is an Fc and it is located at the C-terminus of the molecule (i.e., the Fc is attached to the C-terminus of the Siglec-9 ECD either directly or via a linker). In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID Nos: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID No: 143. In some embodiments, the Fc is a human IgG4, with or without an S228P substitution. Thus, in some embodiments, the Fc comprises the amino acid sequence of SEQ ID NO: 145 or 146.

In some embodiments, a Siglec-9 ECD fusion molecule comprises an amino acid sequence selected from any one of SEQ ID Nos: 49-77 and 171-193, lacking a signal sequence. In some embodiments, a Siglec-9 ECD fusion molecule comprises an amino acid sequence selected from any one of SEQ ID Nos: 49-77 and 171-193, including a signal sequence. In some embodiments, a Siglec-9 ECD fusion molecule consists of an amino acid sequence selected from any one of SEQ ID Nos: 49-77 and 171-193, lacking a signal sequence. In some embodiments, a Siglec-9 ECD fusion molecule consists of an amino acid sequence selected from any one of SEQ ID Nos: 49-77 and 171-193, including a signal sequence.

In some embodiments, a Siglec-9 ECD or a Siglec-9 ECD fusion molecule comprises the amino acid sequence of SEQ ID No: 138. In some embodiments, the Siglec-9 ECD lacks the membrane proximal region (MPR) sequence of SEQ ID NO: 147. In some cases, the Siglec-9 ECD consists of the amino acid sequence of SEQ ID NO: 138. In some cases, the Siglec-9 ECD comprises or consists of the amino acid sequence of SEQ ID NO: 138 lacking the signal sequence, but wherein the Siglec-9 ECD has been expressed from a nucleic acid encoding SEQ ID NO: 138 including the signal sequence. In some cases, the Siglec-9 ECD is a Siglec-9 ECD fusion molecule comprising the ECD and a fusion partner. In some such embodiments, the fusion partner may be an Fc, albumin, or PEG. In some embodiments, the fusion partner is an Fc. In some embodiments, the fusion partner is an Fc and it is located at the C-terminus of the molecule (i.e., the Fc is attached to the C-terminus of the Siglec-9 ECD either directly or via a linker). In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID NO: 143. In some embodiments, the Fc is a human IgG4, with or without an S228P substitution. Thus, in some embodiments, the Fc comprises the amino acid sequence of SEQ ID NO: 145 or 146. In some embodiments, the Siglec-9 ECD fusion molecule comprises the amino acid sequence of SEQ ID NO: 139.

In some embodiments, a Siglec-9 ECD or Siglec-9 ECD fusion molecule comprises the sequence of SEQ ID NO: 78. In some embodiments, the Siglec-9 ECD lacks the membrane proximal region sequence of SEQ ID NO: 147 (MPR). In some cases, the Siglec-9 ECD consists of the amino acid sequence of SEQ ID NO: 78. In some cases, the Siglec-9 ECD is a Siglec-9 ECD fusion molecule comprising the ECD and a fusion partner. In some such embodiments, the fusion partner may be an Fc, albumin, or PEG. In some embodiments, the fusion partner is an Fc. In some embodiments, the fusion partner is an Fc and it is located at the C-terminus of the molecule (i.e., the Fc is attached to the C-terminus of the Siglec-9 ECD either directly or via a linker). In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID NO: 143. In some embodiments, the Fc is a human IgG4, with or without an S228P substitution. Thus, in some embodiments, the Fc comprises the amino acid sequence of SEQ ID NO: 145 or 146.

In some cases, a Siglec-9 ECD fusion molecule comprises the Siglec-9 ECD of SEQ ID NO: 78 joined at its C-terminus to an Fc domain or another fusion partner such as albumin or PEG, optionally via a linker or directly. In some embodiments, SEQ ID NO: 78 is directly linked at its C-terminus to an Fc domain. In some embodiments SEQ ID NO: 78 is joined at its C-terminus to an Fc domain via a linker. In some embodiments, a Siglec-9 ECD fusion molecule comprises the sequence of SEQ ID NO: 78 joined at its C-terminus to a human IgG1 or IgG4 isotype Fc domain, such as an Fc comprising any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc domain comprises SEQ ID NO: 143. In some embodiments, the Fc is a human IgG4, with or without an S228P substitution. In some embodiments, the Fc domain comprises SEQ ID NO: 145. In some embodiments, the Fc domain comprises SEQ ID NO: 146. In some embodiments, the Siglec-9 ECD fusion molecule comprises the amino acid sequence of SEQ ID NO: 10. In some embodiments, the Siglec-9 ECD fusion molecule consists of the amino acid sequence of SEQ ID NO: 10. In some embodiments, the Siglec-9 ECD fusion molecule comprises the amino acid sequence of SEQ ID NO: 227. In some embodiments, the Siglec-9 ECD fusion molecule consists of the amino acid sequence of SEQ ID NO: 227.

In some embodiments, a Siglec-9 ECD fusion molecule comprises the amino acid sequence of SEQ ID NO: 78 joined at its C-terminus to an Fc domain, wherein the molecule comprises an amino acid sequence selected from any one of SEQ ID Nos: 45-48 and 228-233, lacking its associated signal peptide. In some embodiments, a Siglec-9 ECD fusion molecule comprises the amino acid sequence of SEQ ID NO: 78 joined at its C-terminus to an Fc domain, wherein the molecule comprises an amino acid sequence selected from any one of SEQ ID Nos: 45-48 and 228-233, including its associated signal peptide. In some embodiments, the molecule comprises the amino acid sequence of SEQ ID NO: 45. In some embodiments, the molecule consists of the amino acid sequence of SEQ ID NO: 45. In some embodiments, the molecule comprises the amino acid sequence of SEQ ID NO: 48. In some embodiments, the molecule consists of the amino acid sequence of SEQ ID NO: 48. In some embodiments, the molecule comprises the amino acid sequence of SEQ ID NO: 228. In some embodiments, the molecule consists of the amino acid sequence of SEQ ID NO: 228. In some embodiments, the molecule comprises the amino acid sequence of SEQ ID NO: 229. In some embodiments, the molecule consists of the amino acid sequence of SEQ ID NO: 229. In some embodiments, the molecule comprises the amino acid sequence of SEQ ID NO: 230. In some embodiments, the molecule consists of the amino acid sequence of SEQ ID NO: 230. In some embodiments, the molecule comprises the amino acid sequence of SEQ ID NO: 231. In some embodiments, the molecule consists of the amino acid sequence of SEQ ID NO: 231. In some embodiments, the molecule comprises the amino acid sequence of SEQ ID NO: 232. In some embodiments, the molecule consists of the amino acid sequence of SEQ ID NO: 232. In some embodiments, the molecule comprises the amino acid sequence of SEQ ID NO: 233. In some embodiments, the molecule consists of the amino acid sequence of SEQ ID NO: 233.

In some embodiments, a Siglec-9 ECD comprises the sequence of SEQ ID NO: 218. In some embodiments, the Siglec-9 ECD comprises the sequence of SEQ ID NO: 198. In some embodiments, the Siglec-9 ECD comprises the sequence of SEQ ID NO: 218 or 198, and lacks the membrane proximal region (MPR) sequence of SEQ ID NO: 147. In some cases, the Siglec-9 ECD consists of the amino acid sequence of SEQ ID NO: 198. In some cases, the Siglec-9 ECD is a Siglec-9 ECD fusion molecule comprising the ECD and a fusion partner. In some such embodiments, the fusion partner may be an Fc, albumin, or PEG. In some embodiments, the fusion partner is an Fc. In some embodiments, the fusion partner is an Fc and it is located at the C-terminus of the molecule (i.e., the Fc is attached to the C-terminus of the Siglec-9 ECD either directly or via a linker). In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID NO: 143. In some embodiments, the Fc is a human IgG4, with or without an S228P substitution. Thus, in some embodiments, the Fc comprises the amino acid sequence of SEQ ID NO: 145 or 146. In some embodiments, the Siglec-9 ECD or Siglec-9 ECD fusion molecule comprises a signal sequence. In other embodiments, it does not. In some embodiments, the Siglec-9 ECD fusion molecule comprises the amino acid sequence of SEQ ID NO: 152. In some embodiments, the Siglec-9 ECD fusion molecule consists of the amino acid sequence of SEQ ID NO: 152. In some embodiments, the Siglec-9 ECD fusion molecule comprises the amino acid sequence of SEQ ID NO: 168. In some embodiments, the Siglec-9 ECD fusion molecule consists of the amino acid sequence of SEQ ID NO: 168. In some embodiments, the Siglec-9 ECD fusion molecule comprises the amino acid sequence of SEQ ID NO: 175. In some embodiments, the Siglec-9 ECD fusion molecule consists of the amino acid sequence of SEQ ID NO: 175. In some embodiments, the Siglec-9 ECD fusion molecule comprises the amino acid sequence of SEQ ID NO: 191. In some embodiments, the Siglec-9 ECD fusion molecule consists of the amino acid sequence of SEQ ID NO: 191.

In some embodiments, a Siglec-9 ECD comprises the sequence of SEQ ID NO: 219. In some embodiments, the Siglec-9 ECD comprises the sequence of SEQ ID NO: 199. In some embodiments, the Siglec-9 ECD comprises the sequence of SEQ ID NO: 219 or 199, and lacks the membrane proximal region (MPR) sequence of SEQ ID NO: 147. In some cases, the Siglec-9 ECD consists of the amino acid sequence of SEQ ID NO: 199. In some cases, the Siglec-9 ECD is a Siglec-9 ECD fusion molecule comprising the ECD and a fusion partner. In some such embodiments, the fusion partner may be an Fc, albumin, or PEG. In some embodiments, the fusion partner is an Fc. In some embodiments, the fusion partner is an Fc and it is located at the C-terminus of the molecule (i.e., the Fc is attached to the C-terminus of the Siglec-9 ECD either directly or via a linker). In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID NO: 143. In some embodiments, the Fc is a human IgG4, with or without an S228P substitution. Thus, in some embodiments, the Fc comprises the amino acid sequence of SEQ ID NO: 145 or 146. In some embodiments, the Siglec-9 ECD or Siglec-9 ECD fusion molecule comprises a signal sequence. In other embodiments, it does not. In some embodiments, the Siglec-9 ECD fusion molecule comprises the amino acid sequence of SEQ ID NO: 153. In some embodiments, the Siglec-9 ECD fusion molecule consists of the amino acid sequence of SEQ ID NO: 153. In some embodiments, the Siglec-9 ECD fusion molecule comprises the amino acid sequence of SEQ ID NO: 169. In some embodiments, the Siglec-9 ECD fusion molecule consists of the amino acid sequence of SEQ ID NO: 169. In some embodiments, the Siglec-9 ECD fusion molecule comprises the amino acid sequence of SEQ ID NO: 176. In some embodiments, the Siglec-9 ECD fusion molecule consists of the amino acid sequence of SEQ ID NO: 176. In some embodiments, the Siglec-9 ECD fusion molecule comprises the amino acid sequence of SEQ ID NO: 192. In some embodiments, the Siglec-9 ECD fusion molecule consists of the amino acid sequence of SEQ ID NO: 192.

In some embodiments, a Siglec-9 ECD comprises the sequence of SEQ ID NO: 220. In some embodiments, the Siglec-9 ECD comprises the sequence of SEQ ID NO: 200. In some embodiments, the Siglec-9 ECD comprises the sequence of SEQ ID NO: 220 or 200, and lacks the membrane proximal region (MPR) sequence of SEQ ID NO: 147. In some cases, the Siglec-9 ECD consists of the amino acid sequence of SEQ ID NO: 200. In some cases, the Siglec-9 ECD is a Siglec-9 ECD fusion molecule comprising the ECD and a fusion partner. In some such embodiments, the fusion partner may be an Fc, albumin, or PEG. In some embodiments, the fusion partner is an Fc. In some embodiments, the fusion partner is an Fc and it is located at the C-terminus of the molecule (i.e., the Fc is attached to the C-terminus of the Siglec-9 ECD either directly or via a linker). In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID NO: 143. In some embodiments, the Fc is a human IgG4, with or without an S228P substitution. Thus, in some embodiments, the Fc comprises the amino acid sequence of SEQ ID NO: 145 or 146. In some embodiments, the Siglec-9 ECD or Siglec-9 ECD fusion molecule comprises a signal sequence. In other embodiments, it does not. In some embodiments, the Siglec-9 ECD fusion molecule comprises the amino acid sequence of SEQ ID NO: 154. In some embodiments, the Siglec-9 ECD fusion molecule consists of the amino acid sequence of SEQ ID NO: 154. In some embodiments, the Siglec-9 ECD fusion molecule comprises the amino acid sequence of SEQ ID NO: 170. In some embodiments, the Siglec-9 ECD fusion molecule consists of the amino acid sequence of SEQ ID NO: 170. In some embodiments, the Siglec-9 ECD fusion molecule comprises the amino acid sequence of SEQ ID NO: 177. In some embodiments, the Siglec-9 ECD fusion molecule consists of the amino acid sequence of SEQ ID NO: 177. In some embodiments, the Siglec-9 ECD fusion molecule comprises the amino acid sequence of SEQ ID NO: 193. In some embodiments, the Siglec-9 ECD fusion molecule consists of the amino acid sequence of SEQ ID NO: 193.

In some embodiments, a Siglec-9 ECD fusion molecule comprises the amino acid sequence of any one of SEQ ID Nos: 207-213 joined at its C-terminus to an Fc domain. In some embodiments, the joining is direct. In other cases it is through a linker. In some embodiments, the Fc is a human IgG1 (hIgG1). In some embodiments, the Fc comprises the amino acid sequence of any one of SEQ ID Nos: 142-144 and 234-239. In some embodiments, the Fc comprises the amino acid sequence of SEQ ID NO: 142. In some embodiments, the Fc domain has an hIgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises a human IgG1 isotype with N325S and L328F (NSLF) substitutions. In some embodiments, the Fc comprises the amino acid sequence of SEQ ID NO: 143. In some embodiments, the Fc is a human IgG4, with or without an S228P substitution. Thus, in some embodiments, the Fc comprises the amino acid sequence of SEQ ID NO: 145 or 146. In some embodiments, the Siglec-9 ECD fusion molecule comprises an amino acid sequence selected from any one of SEQ ID Nos: 161-167. In some embodiments, the Siglec-9 ECD fusion molecule comprises an amino acid sequence selected from any one of SEQ ID Nos: 184-190, lacking its associated signal peptide. In some embodiments, the Siglec-9 ECD fusion molecule comprises an amino acid sequence selected from any one of SEQ ID Nos: 184-190, including its associated signal peptide.

Exemplary Fc Domains

In some embodiments of any of the Siglec-9 ECD fusion molecules provided herein, the fusion molecule may comprise an Fc domain. In some embodiments, the Fc domain is a human IgG1, IgG2, IgG3, and/or IgG4 isotype.

In certain embodiments of any of the Siglec-9 ECD fusion molecules provided herein, the Fc domain has an IgG1 isotype. In some embodiments, the Siglec-9 ECD fusion molecule contains a murine IgG1 Fc domain. In some embodiments, the Siglec-9 ECD fusion molecule contains a human IgG1 Fc domain (hIgG1), e.g., as provided in SEQ ID NO: 142. In some embodiments, the human IgG1 Fc domain of the Siglec-9 ECD fusion molecule binds an activating Fc receptor. In certain embodiments, the activating Fc receptor is selected from any one or more of FcγRI, FcγRIIa and IIc, and FcγRIIIa and IIIb.

In some embodiments, the human IgG1 Fc domain of the Siglec-9 ECD fusion molecule does not bind or has reduced binding to FcγRIII (CD16) and/or C1q. In some embodiments, the human IgG1 Fc domain of the Siglec-9 ECD fusion molecule has reduced antibody-dependent cellular cytotoxicity (ADCC) and/or complement binding activity, respectively, which in each case may reduce undesired killing of cells, e.g., myeloid cells, to which the Siglec-9 ECD fusion molecule binds. The above effects may be achieved by certain amino acid modifications, e.g., the "NSLF" mutations, in which an IgG1 Fc domain contains the mutations N325S and L328F (by EU numbering of the IgG1 Fc domain), as shown, e.g., in SEQ ID NO: 143. In another embodiment, the human IgG1 Fc domain comprises a mutation corresponding to K322A (EU numbering), e.g., as provided in SEQ ID NO: 144.

Exemplary modifications to the IgG1 Fc domain are listed below in Table A.

TABLE A

| Exemplary modifications to the IgG1 Fc domain Mutation (EU numbering scheme) |
|---|
| N325S and L328F ("NSLF") |
| S267E and L328F ("SELF") |
| P331S ("PS") |
| P331S and E430G ("PSEG") |
| K322A |
| L234A, L235A, and P331S ("LALAPS") |
| (Substantially abolishes Fc binding to FcR) |

For example, in some embodiments, the Fc domain has a human IgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises SEQ ID NO: 143. In some cases, the Fc domain comprises a human IgG1 isotype with N325S and L328F (NSLF) substitutions.

In some embodiments, substitutions and variations can also be made in the Fc region of a Siglec-9-hIgG1 NSLF (see, e.g., SEQ ID NO:45), for example, to improve its binding to FcRn in vitro, and therefore potentially improve its ability to be recycled in vivo. Exemplary substitutions and variations include the "YTE" and "LS" substitutions, and cysteine-containing loop insertions, as described in Dall'Acqua et al. (2002) *J. Immunol.* 169:5171-5180; Zalevsky et al. (2010) *Nat. Biotechnol.* 28:157-159; and U.S. Pat. No. 9,688,756, which are each incorporated herein by reference in their entirety. In some embodiments, an Fc domain may have a sequence as shown in SEQ ID Nos: 228-230 (the substitutions and variations are indicated by double-underlined residues in the sequence table herein). Modified constructs can be tested for improved binding to FcRn in vitro, e.g., via surface plasmon resonance, and then examined for pharmacokinetics (PK) and pharmacodynamics (PD) in vivo. Modified Fc constructs may also contain the "YTE" or "LS" substitution or cysteine-containing loop insertion, but not the NSLF substitution, in the Fc. Such constructs are shown in SEQ ID Nos: 231-233.

In certain embodiments of any of the Siglec-9 ECD fusion molecules provided herein, the Fc domain has an IgG2 isotype. In some embodiments, the Siglec-9 ECD fusion molecule contains a murine IgG2 Fc domain, e.g., murine IgG2a (mIgG2a). In some embodiments, the Siglec-9 ECD fusion molecule contains a human IgG2 Fc domain (hIgG2). In some embodiments, the human IgG2 Fc domain of the Siglec-9 ECD fusion molecule binds an activating Fc receptor. In certain embodiments, the activating Fc receptor is selected from any one or more of FcγRI, FcγRIIa and IIc, and FcγRIIIa and IIIb.

In certain embodiments of any of the Siglec-9 ECD fusion molecules provided herein, the Fc domain has an IgG4 isotype. In some embodiments, the Siglec-9 ECD fusion molecule contains a human IgG4 Fc domain (hIgG4), e.g., as provided in SEQ ID NO: 145. In some embodiments, the human IgG4 Fc region of the Siglec-9 ECD fusion molecule binds an activating Fc receptor. In certain embodiments, the activating Fc receptor is selected from any one or more of FcγRI, FcγRIIa and IIc, and FcγRIIIa and IIIb. In certain embodiments, the human IgG4 Fc region comprises a mutation corresponding to S228P (by EU numbering), e.g., as provided in SEQ ID NO: 146.

Polypeptide Variants

In some embodiments of any of the polypeptides provided herein, amino acid sequence variants are contemplated. For example, it may be desirable to improve the binding affinity and/or other biological properties of the polypeptide.

Substitution, Insertion, and Deletion Variants

In some embodiments of any of the polypeptides provided herein, polypeptide variants having one or more amino acid substitutions are provided Amino acid sequence variants of polypeptide may be prepared by introducing appropriate modifications into the nucleotide sequence encoding the polypeptide, or by peptide synthesis. Such modifications include, for example, deletions from, and/or insertions into and/or substitutions of residues within the amino acid sequences of the polypeptide.

TABLE B

Amino Acid Substitutions

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Leu; Val; Ile; Ala; Tyr | Tyr |
| Pro (P) | Ala | Ala |
| Ser (S) | Thr | Thr |
| Thr (T) | Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Modifications in the biological properties of a polypeptide may be accomplished by selecting substitutions that differ in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties:

(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro; and
(6) aromatic: Trp, Tyr, Phe.

For example, non-conservative substitutions can involve the exchange of a member of one of these classes for a member from another class. Such substituted residues can be introduced, for example, into regions of a human polypeptide that are homologous with non-human polypeptides, or into the non-homologous regions of the molecule.

In making changes to the polypeptide described herein, according to certain embodiments, the hydropathic index of amino acids can be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art. Kyte et al. *J. Mol. Biol.*, 157:105-131 (1982). It is known that certain amino acids can be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those which are within ±1 are included, and in certain embodiments, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0±1); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those which are within ±1 are included, and in certain embodiments, those within ±0.5 are included.

Amino acid sequence insertions include amino- and/or carboxyl-terminal fusions ranging in length from one residue to polypeptides comprising a hundred or more residues, as well as intra-sequence insertions of single or multiple amino acid residues.

Any cysteine residue not involved in maintaining the proper conformation of the polypeptide also may be substituted, generally with serine, to improve the oxidative stability of the molecule and prevent aberrant crosslinking Conversely, cysteine bond(s) may be added to a polypeptide to improve its stability.

Other Polypeptide Modifications

In some embodiments of any of the polypeptides, the polypeptides is a derivative. The term "derivative" refers to a molecule that includes a chemical modification other than an insertion, deletion, or substitution of amino acids (or nucleic acids). In certain embodiments, derivatives comprise covalent modifications, including, but not limited to, chemical bonding with polymers, lipids, or other organic or inorganic moieties. In certain embodiments, a chemically modified polypeptide can have a greater circulating half-life than polypeptide that is not chemically modified. In certain embodiments, a chemically modified polypeptide can have improved targeting capacity for desired cells, tissues, and/or organs. In some embodiments, a derivative polypeptide is covalently modified to include one or more water soluble polymer attachments, including, but not limited to, polyethylene glycol, polyoxyethylene glycol, or polypropylene glycol. See, e.g., U.S. Pat. Nos. 4,640,835, 4,496,689, 4,301, 144, 4,670,417, 4,791,192 and 4,179,337. In certain embodiments, a derivative polypeptide comprises one or more polymer, including, but not limited to, monomethoxypolyethylene glycol, dextran, cellulose, copolymers of ethylene glycol/propylene glycol, carboxymethylcellulose, polyvinyl pyrrolidone, poly-1, 3-dioxolane, poly-1,3,6-trioxane, ethylene/maleic anhydride copolymer, polyaminoacids (either homopolymers or random copolymers), poly-(N-vinyl pyrrolidone)-polyethylene glycol, propylene glycol homopolymers, a polypropylene oxide/ethylene oxide copolymer, polyoxyethylated polyols (e.g., glycerol) and polyvinyl alcohol, as well as mixtures of such polymers.

In certain embodiments, a derivative is covalently modified with polyethylene glycol (PEG) subunits. In certain embodiments, one or more water-soluble polymer is bonded at one or more specific position, for example at the amino terminus, of a derivative. In certain embodiments, one or more water-soluble polymer is randomly attached to one or more side chains of a derivative. In certain embodiments, PEG is used to improve the therapeutic capacity of a polypeptide. Certain such methods are discussed, for example, in U.S. Pat. No. 6,133,426, which is hereby incorporated by reference for any purpose.

Nucleic Acids, Vectors, and Host Cells

Siglec-9 ECD fusion molecules of the present disclosure may be produced using recombinant methods and compositions. In some embodiments, isolated nucleic acids having a nucleotide sequence encoding any of the Siglec-9 ECD fusion molecules of the present disclosure are provided. For example, nucleic acids herein may encode a polypeptide of any one of SEQ ID Nos: 10-39, 78, 138, 148-170, and 227. Nucleic acids herein may encode an amino acid sequence selected from any one of SEQ ID Nos: 45-77, 171-193, and 228-233.

In some embodiments, a nucleic acid encodes a Siglec-9 ECD fusion molecule that includes a signal sequence. In some embodiments, the signal sequence is a native signal sequence. A native human Siglec-9 signal sequence is shown in SEQ ID NO: 140. In some embodiments, the signal sequence is a non-native signal sequence. One skilled in the art would understand that any signal sequence may be used that appropriately effects intracellular trafficking of the encoded polypeptide, cleavage of the signal sequence, and secretion of the encoded polypeptide from a cell. In some such embodiments, the nucleic acid encodes a Siglec-9 ECD fusion molecule comprising a signal sequence that improves intracellular trafficking of the encoded polypeptide, signal sequence cleavage and/or secretion of the encoded polypeptide (efficiency and/or yield) relative to the native human Siglec-9 signal sequence. In some such embodiments, the nucleic acid encodes a Siglec-9 ECD fusion molecule comprising a signal sequence, wherein the signal sequence comprises the amino acid sequence of SEQ ID NO: 141. In some embodiments, a signal sequence of SEQ ID NO: 141 improves production of the Siglec-9 ECD fusion molecule.

In some embodiments, one or more nucleic acids herein may encode the amino acid sequence of SEQ ID NO: 10. In some embodiments, one or more nucleic acids herein may encode the amino acid sequence of SEQ ID NO: 45. In some embodiments, one or more nucleic acids herein may encode the amino acid sequence of SEQ ID NO: 48. In some embodiments, one or more nucleic acids herein may encode the amino acid sequence of SEQ ID NO: 138. In some embodiments, one or more nucleic acids herein may encode the amino acid sequence of SEQ ID NO: 139. In some embodiments, one or more nucleic acids herein may encode the amino acid sequence of SEQ ID NO: 227. In some embodiments, one or more nucleic acids herein may encode the amino acid sequence of SEQ ID NO: 228. In some embodiments, one or more nucleic acids herein may encode the amino acid sequence of SEQ ID NO: 229. In some embodiments, one or more nucleic acids herein may encode the amino acid sequence of SEQ ID NO: 230. In some embodiments, one or more nucleic acids herein may encode the amino acid sequence of SEQ ID NO: 231. In some embodiments, one or more nucleic acids herein may encode the amino acid sequence of SEQ ID NO: 232. In some embodiments, one or more nucleic acids herein may encode the amino acid sequence of SEQ ID NO: 233. In some embodiments, one or more nucleic acids herein may encode the amino acid sequence of SEQ ID NO: 48. In some embodiments, one or more nucleic acids herein may encode the amino acid sequence of SEQ ID NO: 198. In some embodiments, one or more nucleic acids herein may encode the amino acid sequence of SEQ ID NO: 199. In some embodiments, one or more nucleic acids herein may encode the amino acid sequence of SEQ ID NO: 200. In some embodiments, one or more nucleic acids herein may encode the amino acid sequence of SEQ ID NO: 218. In some embodiments, one or more nucleic acids herein may encode the amino acid sequence of SEQ ID NO: 219. In some embodiments, one or more nucleic acids herein may encode the amino acid sequence of SEQ ID NO: 220. In some embodiments, one or more nucleic acids herein may encode the amino acid sequence of SEQ ID NO: 152. In some embodiments, one or more nucleic acids herein may encode the amino acid sequence of SEQ ID NO: 153. In some embodiments, one or more nucleic acids herein may encode the amino acid sequence of SEQ ID NO: 154. In some embodiments, one or more nucleic acids herein may encode the amino acid sequence of SEQ ID NO: 168. In some embodiments, one or more nucleic acids herein may encode the amino acid sequence of SEQ ID NO: 169. In some embodiments, one or more nucleic acids herein may encode the amino acid sequence of SEQ ID NO: 170. In some embodiments, one or more nucleic acids herein may encode the amino acid sequence of SEQ ID NO: 175. In some embodiments, one or more nucleic acids herein may encode the amino acid sequence of SEQ ID NO: 176. In some embodiments, one or more nucleic acids herein may encode the amino acid sequence of SEQ ID NO: 177. In some embodiments, one or more nucleic acids herein may encode the amino acid sequence of SEQ ID NO: 191. In some embodiments, one or more nucleic acids herein may encode the amino acid sequence of SEQ ID NO: 192. In some embodiments, one or more nucleic acids herein may encode the amino acid sequence of SEQ ID NO: 193.

In some embodiments, one or more vectors (e.g., expression vectors) comprising any of the above nucleic acids are provided. In some embodiments, a host cell comprising such nucleic acid is also provided. In some embodiments, the host cell comprises (e.g., has been transduced with) a vector comprising a nucleic acid that encodes the Siglec-9 ECD fusion molecule. In some embodiments, the host cell is eukaryotic, e.g., a Chinese Hamster Ovary (CHO) cell or lymphoid cell (e.g., Y0, NS0, Sp20 cell). Host cells of the present disclosure also include, without limitation, isolated cells, in vitro cultured cells, and ex vivo cultured cells.

Methods of making a Siglec-9 ECD fusion molecule of the present disclosure are provided. In some embodiments, the method includes culturing a host cell of the present disclosure comprising a nucleic acid encoding the Siglec-9 ECD fusion molecule, under conditions suitable for expression of the Siglec-9 ECD fusion molecule. In some embodiments, the Siglec-9 ECD fusion molecule is subsequently recovered from the host cell (or host cell culture medium).

For recombinant production of a Siglec-9 ECD fusion molecule of the present disclosure, a nucleic acid encoding the Siglec-9 ECD fusion molecule is isolated and inserted into one or more vectors for further cloning and/or expression in a host cell. Such nucleic acid may be readily isolated and sequenced using conventional procedures.

Suitable vectors comprising a nucleic acid sequence encoding any of the Siglec-9 ECD fusion molecules of the present disclosure include, without limitation, cloning vectors and expression vectors. Suitable cloning vectors can be constructed according to standard techniques, or may be selected from a large number of cloning vectors available in the art. While the cloning vector selected may vary according to the host cell intended to be used, useful cloning vectors generally have the ability to self-replicate, may possess a single target for a particular restriction endonuclease, and/or may carry genes for a marker that can be used in selecting clones comprising the vector. Suitable examples include plasmids and bacterial viruses, e.g., pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Strategene, and Invitrogen.

Suitable host cells for cloning or expression of Siglec-9 ECD fusion molecule-encoding vectors include prokaryotic or eukaryotic cells. For example, Siglec-9 ECD fusion molecules of the present disclosure may be produced in eukaryotes, in particular when glycosylation and Fc effector function contribute to the activity of the molecule.

In addition to prokaryotes, eukaryotic microorganisms, such as filamentous fungi or yeast, are also suitable cloning or expression hosts for Siglec-9 ECD fusion molecule-encoding vectors, including fungi and yeast strains whose glycosylation pathways have been "humanized," resulting in the production of a Siglec-9 ECD fusion molecule with a partially or fully human glycosylation pattern (e.g., Gerngross *Nat. Biotech.* 22:1409-1414 (2004); and Li et al. *Nat. Biotech.* 24:210-215 (2006)).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al. *J. Gen Virol.* 36:59 (1977)), which were used to recombinantly produce the Siglec-9 ECD fusion molecules of the Examples herein; baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al. *Annals N.Y. Acad. Sci.* 383:44-68 (1982); MRC 5 cells; and FS4 cells. Other useful mammalian host cell lines include Chinese hamster ovary (CHO) cells, including DHFR-CHO cells (Urlaub et al. *Proc. Natl. Acad. Sci. USA* 77:4216 (1980)); and myeloma cell lines such as Y0, NS0 and Sp2/0.

Exemplary Activities of Siglec-9 ECD Fusion Molecules

Provided herein are polypeptides comprising a Siglec-9 ECD, wherein the polypeptide binds sialic acid on the surface of cells. The polypeptide comprising a Siglec-9 ECD may be a Siglec-9 ECD fusion molecule such as a Siglec-9 ECD-Fc fusion molecule. A polypeptide comprising a Siglec-9 ECD may bind cells comprising sialic acid on the surface with an affinity (Kd) of less than 100 nM, or less than 90 nM, or less than 80 nM, or less than 70 nM, or less than 60 nM, or less than 50 nM, or less than 40 nM, or less than 30 nM. In some embodiments, the polypeptide binds cells comprising sialic acid on the surface with an affinity (Kd) of 0.1-100 nM, or 0.1-90 nM, or 0.1-80 nM, or 0.1-70 nM, or 0.1-60 nM, or 0.1-50 nM, or 0.1-40 nM, or 0.1-30 nM. In some embodiments, the Siglec-9 ECD or Siglec-9 ECD fusion molecule may bind to MDSCs with a Kd of, for example, less than less than 100 nM, or less than 90 nM, or less than 80 nM, or less than 70 nM, or less than 60 nM, or less than 50 nM, or less than 40 nM, or less than 30 nM, or less than 25 nM, or less than 20 nM, or less than 10 nM, or less than 5 nM, or less than 2 nM, or 0.1-50 nM, or 1-50 nM, or 1-25 nM, or 1-20 nM, or 1-10 nM, or 1-5 nM, or 1-2 nM. In various embodiments, the cells are myeloid-derived suppressor cells (MDSCs). In some cases, the MDSCs are human MDSCs.

A nonlimiting exemplary assay for determining affinity is as follows. MDSCs, such as human MDSCs, are isolated and incubated with titrating amounts of a polypeptide comprising a Siglec-9 ECD-Fc fusion molecule. A fluorescently-tagged anti-Fc domain antibody (e.g., an antibody that binds IgG1 Fc domain) is used for detection, and binding is evaluated by flow cytometry. In some embodiments, a non-human Fc domain (e.g., a mouse IgG1 Fc domain) is used in the fusion molecule, in order to reduce background binding of the fluorescently-tagged anti-Fc domain antibody to the MDSCs. An exemplary assay is provided in Example 7.

In some embodiments, a polypeptide comprising a Siglec-9 ECD repolarizes myeloid-derived suppressor cells (MDSCs). The polypeptide comprising a Siglec-9 ECD may be a Siglec-9 ECD fusion molecule such as a Siglec-9 ECD-Fc fusion molecule. Repolarization of MDSCs may be determined, for example, by measuring increased chemokine expression from MDSCs incubated with the polypeptides. Nonlimiting exemplary chemokines whose expression may be increased, indicating repolarization of MDSCs, include CCL3, CCL4, CCL5, CCL17, CXCL1, CXCL9, and IL-8. An assay to determine repolarization may measure expression of one, two, three, four, five or more chemokines. Repolarization of MDSCs may also be determined by measuring expression of CD86 and/or CD163 expression on the MDSCs cultured in the presence of a polypeptide comprising a Siglec-9 ECD. CD86 is a pro-inflammatory marker, and an increase in CD86 expression is consistent with repolarization of MDSCs. CD163 is an M2 macrophage marker, and a decrease in CD163 expression is consistent with repolarization of MDSCs toward a pro-inflammatory phenotype. An exemplary assay is provided in Example 8.

In some embodiments, a polypeptide comprising a Siglec-9 ECD relieve MDSC-mediated suppression of T cells. The polypeptide comprising a Siglec-9 ECD may be a Siglec-9 ECD fusion molecule such as a Siglec-9 ECD-Fc fusion molecule. A nonlimiting exemplary assay for determining relief of MDSC-mediated suppression of T cells is as follows. MDSCs are isolated and cultured, e.g., for 48 hours, with the polypeptide. The MDSCs are then co-cultured with isolated T cells (e.g., CD8+ T cells) and T-cell activator, such as Dynabeads® Human T-Activator CD3/CD28. T cell activation may be determined by measuring IFNγ expression. In some embodiments, IFNγ expression is increased, indicating T cell activation, when MDSCs are incubated with a polypeptide comprising the Siglec-9 ECD, compared to control polypeptide. An exemplary assay is provided in Example 9.

In some embodiments, a polypeptide comprising a Siglec-9 ECD, blocks binding of other Siglecs to MDSCs. In some such embodiments, the polypeptide blocks binding of Siglec-3, Siglec-5, Siglec-7, Siglec-9, and/or Siglec-10 to MDSCs. Binding may be measured, for example, using the flow cytometry assay described herein for measuring Kd. An exemplary assay is provided in Example 19.

In some embodiments, a Siglec-9 ECD fusion molecule may comprise the amino acid sequence of SEQ ID NO: 78 joined at its C-terminus to an Fc domain, either directly or via a linker molecule, such as the amino acid sequence of SEQ ID NO: 10 or SEQ ID NO: 227, or of any one of SEQ ID NO: 45-48 and 228-233, with or without the signal sequence. In some such cases, the molecule may bind to MDSCs, such as human MDSCs, with a Kd of, for example, less than 100 nM, or less than 90 nM, or less than 80 nM, or less than 70 nM, or less than 60 nM, or less than 50 nM, or less than 40 nM, or less than 30 nM, or less than 25 nM, or less than 20 nM, or less than 10 nM, or less than 5 nM, or less than 2 nM, or 0.1-50 nM, or 1-50 nM, or 1-25 nM, or 1-20 nM, or 1-10 nM, or 1-5 nM, or 1-2 nM.

For example, in some embodiments, the Fc domain has a human IgG1 isotype that has: a) reduced binding to FcγRIII; b) reduced antibody-dependent cellular cytotoxicity (ATCC) and/or reduced complement binding activity; c) increased binding to FcγRIIa; or any combination of a), b), and/or c), relative to the IgG1 polypeptide of SEQ ID No: 142. In some cases, the Fc domain comprises SEQ ID NO: 143. In some cases, the Fc domain comprises a human IgG1 isotype with N325S and L328F (NSLF) substitutions. In some such cases, such a molecule may also have increased potency in inducing IFNγ production in the presence of MDSCs compared to a Siglec-9 ECD with the same amino acid sequence, but joined at its C-terminus to an hIgG1 wild-type Fc molecule. In some embodiments, the molecule may relieve MDSC-mediated suppression of T-cells, for example, as determined by measuring an increase in IFNγ expression or an increase in T-cell proliferation. In some cases, such a molecule may increase expression of CD86 on MDSCs and/or may decrease expression of CD206 on MDSCs. In some cases, such a molecule may also bind to MDSCs, such as human MDSCs, with a Kd that is lower than that of a molecule comprising a Siglec-9 ECD of the same amino acid sequence but joined at its C-terminus to an hIgG1 wild-type Fc.

Pharmaceutical Compositions/Formulations

Provided herein are pharmaceutical compositions comprising a Siglec-9 ECD fusion molecule, such as a Siglec-9 ECD-Fc fusion molecule, of the present disclosure and a pharmaceutically acceptable carrier. In some embodiments, provided herein are pharmaceutical compositions comprising the Siglec-9 ECD fusion molecules of the present disclosure having the desired degree of purity in a physiologically acceptable carrier, excipient or stabilizer (Remington's Pharmaceutical Sciences (1990) Mack Publishing Co., Easton, Pa.). Acceptable carriers, excipients, or stabilizers are nontoxic to recipients at the dosages and concentrations employed.

In various embodiments, pharmaceutical compositions comprising a Siglec-9 ECD fusion molecule are provided in formulations with a pharmaceutically acceptable carrier (see, e.g., Gennaro, Remington: The Science and Practice of Pharmacy with Facts and Comparisons: Drugfacts Plus, 20th ed. (2003); Ansel et al., Pharmaceutical Dosage Forms and Drug Delivery Systems, 7th ed., Lippencott Williams and Wilkins (2004); Kibbe et al., Handbook of Pharmaceutical Excipients, 3rd ed., Pharmaceutical Press (2000)). Formulations suitable for parenteral administration include aqueous and non-aqueous, isotonic sterile injection solutions, which can comprise antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives.

Therapeutic Uses

As disclosed herein, Siglec-9 ECD fusion molecules, e.g., Siglec-9 ECD-Fc fusion molecules, of the present disclosure may be used for preventing, reducing risk, or treating diseases and disorders. In addition, Siglec-9 ECD fusion molecules, e.g. Siglec-9 ECD-Fc fusion molecules, of the present disclosure may be used in methods of repolarizing myeloid-deprived suppressor cells (MDSCs) to a pro-inflammatory phenotype, e.g., wherein the subject has cancer or a neurological or neurodegenerative disease, as described below. Siglec-9 ECD fusion molecules, e.g. Siglec-9 ECD-Fc fusion molecules, of the present disclosure may also be used in methods of activating myeloid cells, e.g., wherein the subject has cancer or a neurological or neurodegenerative disease, as described below. Siglec-9 ECD fusion molecules, e.g. Siglec-9 ECD-Fc fusion molecules, of the present disclosure may be further used in methods of repolarizing tumor macrophages away from an M2 phenotype in a subject with cancer as described herein.

In one aspect of the invention, a Siglec-9 ECD fusion molecule, e.g., a Siglec-9 ECD-Fc fusion molecule, is used as a therapeutic agent. A therapeutic regimen is carried out by identifying a subject, e.g., a human patient suffering from (or at risk of developing) a disease or disorder that would benefit from treatment with a Siglec-9 ECD fusion molecule.

As further detailed below, a Siglec-9 ECD fusion molecule, e.g., a Siglec-9 ECD-Fc fusion molecule, can be used in combination with an additional therapeutic agent that is used to treat the disease or pathology provided herein. The terms "in combination" and "in conjunction" are used interchangeably in the present disclosure. The additional therapeutic agent being administered in combination with the Siglec-9 ECD fusion molecule may be administered before, after, or concurrently with the Siglec-9 ECD fusion molecule.

In some embodiments, the disease or disorder to be treated is cancer. In certain embodiments, the cancer is a solid tumor. The solid tumor may be associated with a tumor microenvironment comprising myeloid cells, e.g., macrophages, monocytes, microglia (in the CNS), dendritic cells, neutrophils, and/or granulocytes. In certain embodiments, the tumor microenvironment comprises macrophages and monocytes. In certain embodiments, myeloid cells create an immunosuppressive tumor microenvironment in which a tumor can evade the immune system. Treatment with a Siglec-9 ECD fusion molecule herein may alleviate this suppression by activating myeloid cells and promoting an anti-tumor immune response.

In certain embodiments, a cancer to be prevented or treated by the methods of the present disclosure includes, without limitation, squamous cell carcinoma (e.g., epithelial squamous cell carcinoma), lung cancer, small-cell lung cancer, non-small cell lung cancer (NSCLC), squamous non-small cell lung cancer, adenocarcinoma of the lung, squamous carcinoma of the lung, non-squamous NSCLC, glioma, cancer of the peritoneum, hepatocellular cancer, gastric cancer or stomach cancer including gastrointestinal cancer and gastrointestinal stromal cancer, renal cancer (e.g. clear cell carcinoma), ovarian cancer, liver cancer, colon cancer, colorectal cancer, endometrial cancer, hepatic carcinoma, kidney cancer (e.g., renal cell carcinoma (RCC)), prostate cancer (e.g. hormone refractory prostate adenocarcinoma), thyroid cancer, neuroblastoma, sarcoma, pancreatic cancer, brain cancer (e.g., astrocytoma such as glioblastoma (glioblastoma multiforme)), cervical cancer, bladder cancer, hepatoma, breast cancer (e.g., triple negative breast cancer), and head and neck cancer (squamous cell carcinoma of the head and neck), melanoma (e.g., metastatic malignant melanoma, such as cutaneous or intraocular malignant melanoma), thyroid cancer, bone cancer, skin cancer, uterine cancer, anal cancer, testicular cancer, carcinoma of the fallopian tubes, vulval cancer, cholangiocarcinoma, and esophageal cancer. In certain embodiments, the cancer is selected from renal cell carcinoma, sarcoma, pancreatic cancer, glioblastoma, ovarian cancer, colorectal cancer, lung cancer, melanoma, bladder cancer, head and neck cancer, breast cancer and uterine cancer.

In certain embodiments, a cancer to be prevented or treated by the methods of the present disclosure includes, without limitation, a hematopoietic cancer, such as a leukemia, lymphoma, or myeloma.

In some embodiments, the cancer may be an early stage cancer or a late stage cancer. In some embodiments, the cancer may be a primary tumor. In some embodiments, the cancer may be a metastatic tumor at a second site derived from any of the above types of cancer.

In some embodiments, the present disclosure provides methods of treating an individual having cancer, wherein the individual has a cancer that is refractory to checkpoint inhibitor therapy, by administering to the individual an effective amount of a Siglec-9 ECD fusion molecule, e.g., a Siglec-9 ECD-Fc fusion molecule, of the present disclosure. In certain embodiments, the individual has a cancer that is refractory to therapy with a PD-1 or PD-L1 antagonist, e.g., a PD-1 or PD-L1 antibody, such as those provided below.

In some embodiments, the present disclosure provides methods of treating an individual having cancer, wherein the individual has a cancer that has recurred after checkpoint inhibitor therapy, by administering to the individual a therapeutically effective amount of a Siglec-9 ECD fusion molecule, e.g., a Siglec-9 ECD-Fc fusion molecule, of the present disclosure. In certain embodiments, the individual has a cancer that has recurred after therapy with a PD-1 or PD-L1 antagonist, e.g., a PD-1 or PD-L1 antibody, such as those provided below In some embodiments, a Siglec-9 ECD fusion molecule, e.g., a Siglec-9 ECD-Fc fusion molecule, of the present disclosure may be administered in conjunction with an antagonist of an inhibitory immune checkpoint molecule. In some embodiments, the inhibitory checkpoint molecule is PD-1 (programmed cell death protein-1) or its ligand PD-L1 (programmed death ligand-1). In some embodiments, an antagonist of PD-1 is an antibody to PD-1. PD-1 antibodies include, for example, OPDIVO (nivolumab), KEYTRUDA (pembrolizumab), MEDI-0680 (AMP-514; WO2012/145493), camrelizumab (SHR-1210), tislelizumab (BGB-A317), or spartalizumab (NPVPDR001, NVS240118, PDR001). A recombinant protein composed of the extracellular domain of PD-L2 (B7-DC) lused to the Fc portion of IgG1, called AMP-224, can also be used to antagonize the PD-1 receptor. In some embodiments, an antagonist of PD-L1 is an antibody to PD-L1. PD-L1 antibodies include, for example, TECENTRIQ (atezolizumab), durvalumab (MEDI4736), BMS-936559 (WO2007/005874), MSB0010718C (WO2013/79174) or rHigM12B7. In some embodiments, a Siglec-9 ECD fusion molecule of the present invention is administered in combination with radiation therapy and/or a chemotherapeutic agent.

In some embodiments, methods are provided for treating a neurological or neurodegenerative disorder by administering to a patient in need thereof a Siglec-9 ECD fusion molecule, such as a Siglec-9 ECD-Fc fusion molecule. In some embodiments, the neurological or neurodegenerative disorder is characterized by dysfunctional (e.g., hypoactive) or deficient microglia. Microglia are innate immune cells that reside specifically in the brain and that function as macrophages, clearing debris and dead neurons through the process of phagocytosis and providing other supportive functions for maintaining brain health. Without being limited by theory, the activation of microglia by a Siglec-9 ECD fusion molecule would treat the neurological or neurodegenerative disorder. In some embodiments, the patient has symptoms of a neurological or neurodegenerative disorder, and the Siglec-9 ECD fusion molecule is administered to treat the neurological or neurodegenerative disorder. In some embodiments, the patient is at risk of a neurological or neurodegenerative disorder, and the Siglec-9 ECD fusion molecule is administered to reduce risk, slow onset, or prevent the neurological or neurodegenerative disorder. In some embodiments, the neurological or neurodegenerative disorder is selected from dementia, including dementia, frontotemporal dementia, Alzheimer's disease, vascular dementia, and mild cognitive impairment, Parkinson's disease, amyotrophic lateral sclerosis (ALS), Huntington's disease, Taupathy disease, multiple sclerosis, immune-mediated neuropathies (such as neuropathic pain), Nasu-Hakola disease, pediatric-onset leukoencephalopathy and adult-onset leukoencephalopathy with axonal spheroids and pigmented glia (ALSP).

Dementia

Dementia is a non-specific syndrome (i.e., a set of signs and symptoms) that presents as a serious loss of global cognitive ability in a previously unimpaired person, beyond what might be expected from normal ageing. Dementia may be static as the result of a unique global brain injury. Alternatively, dementia may be progressive, resulting in long-term decline due to damage or disease in the body. While dementia is much more common in the geriatric population, it can also occur before the age of 65. Cognitive areas affected by dementia include, without limitation, memory, attention span, language, and problem solving. Generally, symptoms must be present for at least six months to before an individual is diagnosed with dementia.

Exemplary forms of dementia include, without limitation, frontotemporal dementia, Alzheimer's disease, vascular dementia, semantic dementia, and dementia with Lewy bodies.

In some embodiments, administering a Siglec-9 ECD fusion molecule of the present disclosure can prevent, reduce the risk, and/or treat dementia. In some embodiments, administering a Siglec-9 ECD fusion molecule, may modulate one or more Siglec-9 activities in an individual having dementia.

Frontotemporal Dementia

Frontotemporal dementia (FTD) is a condition resulting from the progressive deterioration of the frontal lobe of the brain. Over time, the degeneration may advance to the temporal lobe. Second only to Alzheimer's disease (AD) in prevalence, FTD accounts for 20% of pre-senile dementia cases. The clinical features of FTD include memory deficits, behavioral abnormalities, personality changes, and language impairments (Cruts, M. & Van Broeckhoven, C., Trends Genet. 24:186-194 (2008); Neary, D., et al., Neurology 51:1546-1554 (1998); Ratnavalli, E., Brayne, C., Dawson, K. & Hodges, J. R., Neurology 58:1615-1621 (2002)).

A substantial portion of FTD cases are inherited in an autosomal dominant fashion, but even in one family, symptoms can span a spectrum from FTD with behavioral disturbances, to Primary Progressive Aphasia, to Cortico-Basal Ganglionic Degeneration. FTD, like most neurodegenerative diseases, can be characterized by the pathological presence of specific protein aggregates in the diseased brain. Historically, the first descriptions of FTD recognized the presence of intraneuronal accumulations of hyperphosphorylated Tau protein in neurofibrillary tangles or Pick bodies. A causal role for the microtubule associated protein Tau was supported by the identification of mutations in the gene encoding the Tau protein in several families (Hutton, M., et at, Nature 393:702-705 (1998). However, the majority of FTD brains show no accumulation of hyperphosphorylated Tau but do exhibit immunoreactivity to ubiquitin (Ub) and TAR DNA binding protein (TDP43) (Neumann, M., et al., Arch. Neurol. 64:1388-1394 (2007)). A majority of those FTD cases with Ub inclusions (FTD-U) were shown to carry mutations in the Progranulin gene.

In some embodiments, administering a Siglec-9 ECD fusion molecule of the present disclosure, can prevent, reduce the risk, and/or treat FTD. In some embodiments, administering a Siglec-9 ECD fusion molecule, may modulate one or more Siglec-9 activities in an individual having FTD.

Alzheimer's Disease

Alzheimer's disease (AD) is the most common form of dementia. There is no cure for the disease, which worsens as it progresses, and eventually leads to death. Most often, AD is diagnosed in people over 65 years of age. However, the less-prevalent early-onset Alzheimer's can occur much earlier. Common symptoms of Alzheimer's disease include, behavioral symptoms, such as difficulty in remembering recent events; cognitive symptoms, confusion, irritability and aggression, mood swings, trouble with language, and long-term memory loss. As the disease progresses bodily functions are lost, ultimately leading to death. Alzheimer's disease develops for an unknown and variable amount of time before becoming fully apparent, and it can progress undiagnosed for years.

Reported herein is also the observation that the minor allele of rs2075803, a SNP at the Siglec-9 locus on chromosome 19, is associated with an increase in both Siglec-9 levels in plasma and Alzheimer's Disease risk. Additionally, reported herein is the observation that the minor allele of rs12983058, a SNP at the Siglec-7 locus on chromosome 19, is associated with an increase in both Siglec-7 levels in plasma and Alzheimer's Disease risk.

Accordingly, in some embodiments, administering a Siglec-9 ECD fusion molecule of the present disclosure can prevent, reduce the risk, and/or treat Alzheimer's disease. In some embodiments, administering a Siglec-9 ECD fusion molecule may modulate one or more Siglec-9 activities in an individual having Alzheimer's disease.

Parkinson's Disease

Parkinson's disease, which may be referred to as idiopathic or primary parkinsonism, hypokinetic rigid syndrome (HRS), or paralysis agitans, is a neurodegenerative brain disorder that affects motor system control. The progressive death of dopamine-producing cells in the brain leads to the major symptoms of Parkinson's. Most often, Parkinson's disease is diagnosed in people over 50 years of age. Parkinson's disease is idiopathic (having no known cause) in most people. However, genetic factors also play a role in the disease.

Symptoms of Parkinson's disease include, without limitation, tremors of the hands, arms, legs, jaw, and face, muscle rigidity in the limbs and trunk, slowness of movement (bradykinesia), postural instability, difficulty walking, neuropsychiatric problems, changes in speech or behavior, depression, anxiety, pain, psychosis, dementia, hallucinations, and sleep problems.

In some embodiments, administering a Siglec-9 ECD fusion molecule of the present disclosure can prevent, reduce the risk, and/or treat Parkinson's disease. In some embodiments, administering a Siglec-9 ECD fusion molecule may modulate one or more Siglec-9 activities in an individual having Parkinson's disease.

Amyotrophic Lateral Sclerosis (ALS)

As used herein, amyotrophic lateral sclerosis (ALS) or, motor neuron disease or, Lou Gehrig's disease are used interchangeably and refer to a debilitating disease with varied etiology characterized by rapidly progressive weakness, muscle atrophy and fasciculations, muscle spasticity, difficulty speaking (dysarthria), difficulty swallowing (dysphagia), and difficulty breathing (dyspnea).

It has been shown that Progranulin plays a role in ALS (Schymick, J C et al., (2007) J[0343] Neurol Neurosurg Psychiatry; 78:754-6) and protects again the damage caused by ALS causing proteins such as TDP-43 (Laird, A S et al., (2010). PLoS ONE 5: e13368). It was also demonstrated that pro-NGF induces p75 mediated death of oligodendrocytes and corticospinal neurons following spinal cord injury (Beatty et al., Neuron (2002), 36, pp. 375-386; Giehl et al, Proc. Natl. Acad. Sci USA (2004), 101, pp 6226-30).

In some embodiments, administering a Siglec-9 ECD fusion molecule of the present disclosure can prevent, reduce the risk, and/or treat ALS. In some embodiments, administering a Siglec-9 ECD fusion molecule may modulate one or more Siglec-9 activities in an individual having amyotrophic lateral sclerosis.

Huntington's Disease

Huntington's disease (HD) is an inherited neurodegenerative disease caused by an autosomal dominant mutation in the Huntingtin gene (HTT). Expansion of a cytokine-adenine-guanine (CAG) triplet repeat within the Huntingtin gene results in production of a mutant form of the Huntingtin protein (Htt) encoded by the gene. This mutant Huntingtin protein (mHtt) is toxic and contributes to neuronal death. Symptoms of Huntington's disease most commonly appear between the ages of 35 and 44, although they can appear at any age.

Symptoms of Huntington's disease, include, without limitation, motor control problems, jerky, random movements (chorea), abnormal eye movements, impaired balance, seizures, difficulty chewing, difficulty swallowing, cognitive problems, altered speech, memory deficits, thinking difficulties, insomnia, fatigue, dementia, changes in personality, depression, anxiety, and compulsive behavior.

In some embodiments, administering as a Siglec-9 ECD fusion molecule of the present disclosure can prevent, reduce the risk, and/or treat Huntington's disease (HD). In some embodiments, administering a Siglec-9 ECD fusion molecule may modulate one or more Siglec-9 activities in an individual having Huntington's disease.

Tauopathy Disease

Taupathy diseases, or Tauopathies, are a class of neurodegenerative disease caused by aggregation of the microtubule-associated protein tau within the brain. Alzheimer's disease (AD) is the most well-known tauopathy disease and involves an accumulation of tau protein within neurons in the form of insoluble neurofibrillary tangles (NFTs). Other taupathy diseases and disorders include progressive supranuclear palsy, dementia pugilistica (chromic traumatic encephalopathy), frontotemporal dementia and parkinsonism linked to chromosome 17, Lytico-Bodig disease (Parkinson-dementia complex of Guam), Tangle-predominant dementia, Ganglioglioma and gangliocytoma, Meningioangiomatosis, Subacute sclerosing panencephalitis, lead encephalopathy, tuberous sclerosis, Hallervorden-Spatz disease, lipofuscinosis, Pick's disease, corticobasal degeneration, Argyrophilic grain disease (AGD), Huntington's disease, and frontotemporal lobar degeneration.

In some embodiments, administering a Siglec-9 ECD fusion molecule of the present disclosure, can prevent, reduce the risk, and/or treat taupathy disease. In some embodiments, administering a Siglec-9 ECD fusion molecule may modulate one or more Siglec-9 activities in an individual having a taupathy disease.

Multiple Sclerosis

Multiple sclerosis (MS) can also be referred to as disseminated sclerosis or encephalomyelitis disseminata. MS is an inflammatory disease in which the fatty myelin sheaths around the axons of the brain and spinal cord are damaged, leading to demyelination and scarring as well as a broad spectrum of signs and symptoms. MS affects the ability of nerve cells in the brain and spinal cord to communicate with each other effectively. Nerve cells communicate by sending electrical signals called action potentials down long fibers called axons, which are contained within an insulating substance called myelin. In MS, the body's own immune system attacks and damages the myelin. When myelin is lost, the axons can no longer effectively conduct signals. MS onset usually occurs in young adults, and is more common in women.

Symptoms of MS include, without limitation, changes in sensation, such as loss of sensitivity or tingling; pricking or numbness, such as hypoesthesia and paresthesia; muscle weakness; clonus; muscle spasms; difficulty in moving; difficulties with coordination and balance, such as ataxia; problems in speech, such as dysarthria, or in swallowing, such as dysphagia; visual problems, such as nystagmus, optic neuritis including phosphenes, and diplopia; fatigue; acute or chronic pain; and bladder and bowel difficulties; cognitive impairment of varying degrees; emotional symptoms of depression or unstable mood; Uhthoff's phenomenon, which is an exacerbation of extant symptoms due to an exposure to higher than usual ambient temperatures; and Lhermitte's sign, which is an electrical sensation that runs down the back when bending the neck.

In some embodiments, administering a Siglec-9 ECD fusion molecule of the present disclosure, can prevent, reduce the risk, and/or treat MS. In some embodiments, administering a Siglec-9 ECD fusion molecule may modulate one or more Siglec-9 activities in an individual having MS.

Administration

A Siglec-9 ECD fusion molecule, such as a Siglec-9 ECD-Fc fusion molecule, provided herein (and any additional therapeutic agent) can be administered by any suitable means, including parenteral, intrapulmonary, intranasal, intratumoral, intralesional administration, intracerobrospinal, intracranial, intraspinal, intrasynovial, intrathecal, oral, topical, or inhalation routes. Parenteral infusions include intramuscular, intravenous administration as a bolus or by continuous infusion over a period of time, intraarterial, intra-articular, intraperitoneal, or subcutaneous administration. In some embodiments, the administration is intravenous administration. In some embodiments, the administration is subcutaneous. Dosing can be by any suitable route, e.g. by injections, such as intravenous or subcutaneous injections, depending in part on whether the administration is brief or chronic. Various dosing schedules including but not limited to single or multiple administrations over various time-points, bolus administration, and pulse infusion are contemplated herein.

For the prevention or treatment of disease, the appropriate dosage of a Siglec-9 ECD fusion molecule of the invention, such as a Siglec-9 ECD-Fc fusion molecule, when used alone or in combination with one or more other additional therapeutic agents, will depend on the type of disease to be treated, the type of fusion molecule, the severity and course of the disease, whether the fusion molecule is administered for preventive or therapeutic purposes, previous therapy, the patient's clinical history and response to the fusion molecule, and the discretion of the attending physician. The fusion molecule is suitably administered to the patient at one time or over a series of treatments.

Diagnostic Uses

In some embodiments the Siglec-9 ECD fusion molecules provided herein is useful for detecting the presence of a Siglec ligand, e.g., sialic acid, in a sample or an individual. The term "detecting" as used herein encompasses quantitative or qualitative detection. Provided herein are methods of using the Siglec-9 ECD fusion molecules of this disclosure for diagnostic purposes, such as the detection of sialic acid in an individual or in tissue samples derived from an individual. In some embodiments, the individual is a human.

The detection method may involve quantification of the sialic acid-bound Siglec-9 ECD fusion molecule. Such detection in biological samples may occur with any method known in the art, including immunofluorescence microscopy, immunocytochemistry, immunohistochemistry, ELISA, FACS analysis, immunoprecipitation, or micro-positron emission tomography. In certain embodiments, the Siglec-9 ECD fusion molecule is radiolabeled, for example with 18F and subsequently detected utilizing micro-positron emission tomography analysis. Sialic acid binding may also be quantified in a patient by non-invasive techniques such as positron emission tomography (PET), X-ray computed tomography, single-photon emission computed tomography (SPECT), computed tomography (CT), and computed axial tomography (CAT).

Articles of Manufacture

Provided herein are articles of manufacture (e.g., kits) comprising a Siglec-9 ECD fusion molecule, e.g., a Siglec-9 ECD-Fc fusion molecule, as described herein. Article of manufacture may include one or more containers comprising a Siglec-9 ECD fusion molecule described herein. Containers may be any suitable packaging including, but not limited to, vials, bottles, jars, flexible packaging (e.g., sealed Mylar or plastic bags), and the like. The containers may be unit doses, bulk packages (e.g., multi-dose packages) or sub-unit doses.

In some embodiments, the kits may further include a second agent. In some embodiments, the second agent is a pharmaceutically acceptable buffer or diluting agent including, but not limited to, such as bacteriostatic water for injection (BWFI), phosphate-buffered saline, Ringer's solution and dextrose solution. In some embodiments, the second agent is a pharmaceutically active agent as described above.

In some embodiments of any of the articles of manufacture, the article of manufactures further includes instructions for use in accordance with the methods of this disclosure. The instructions generally include information as to dosage, dosing schedule, and route of administration for the intended treatment. In some embodiments, these instructions comprise a description of administration of the Siglec-9 ECD fusion molecule of the present disclosure to prevent, reduce risk, or treat an individual having a disease, disorder, or injury selected from squamous cell carcinoma (e.g., epithelial squamous cell carcinoma), lung cancer, small-cell lung cancer, non-small cell lung cancer (NSCLC), squamous non-small cell lung cancer, adenocarcinoma of the lung, squamous carcinoma of the lung, non-squamous NSCLC, glioma, cancer of the peritoneum, hepatocellular cancer, gastric cancer or stomach cancer including gastrointestinal cancer and gastrointestinal stromal cancer, renal cancer (e.g. clear cell carcinoma), ovarian cancer, liver cancer, colon cancer, colorectal cancer, endometrial cancer, hepatic carcinoma, kidney cancer (e.g., renal cell carcinoma (RCC)), prostate cancer (e.g. hormone refractory prostate adenocarcinoma), thyroid cancer, neuroblastoma, pancreatic cancer, brain cancer (e.g., astrocytoma such as glioblastoma (glioblastoma multiforme)), cervical cancer, bladder cancer, hepatoma, breast cancer (e.g., triple negative breast cancer), and head and neck cancer (squamous cell carcinoma of the head and neck), melanoma (e.g., metastatic malignant melanoma, such as cutaneous or intraocular malignant melanoma), thyroid cancer, bone cancer, skin cancer, uterine cancer, anal cancer, testicular cancer, carcinoma of the fallopian tubes, vulval cancer, cholangiocarcinoma, esophageal cancer, dementia, including dementia, frontotemporal dementia, Alzheimer's disease, vascular dementia, and mild cognitive impairment, Parkinson's disease, amyotrophic lateral sclerosis (ALS), Huntington's disease, Taupathy disease, multiple sclerosis, immune-mediated neuropathies (such as neuropathic pain), Nasu-Hakola disease, pediatric-onset leukoencephalopathy and adult-onset leukoencephalopathy with axonal spheroids and pigmented glia (ALSP), according to any methods of this disclosure. In some embodiments, the instructions include instructions for use of the Siglec-9 ECD fusion molecule and the second agent (e.g., second pharmaceutically active agent).

The present disclosure will be more fully understood by reference to the following Examples. They should not, however, be construed as limiting the scope of the present disclosure. All citations throughout the disclosure are hereby expressly incorporated by reference.

EXAMPLES

The following examples are provided by way of illustration only and not by way of limitation. Those of skill in the art will readily recognize a variety of parameters that could be changed or modified to yield essentially similar results.

Example 1: Siglec-9 is Expressed on the Surface of Myeloid Cells in Human Tumors To examine the expression of Siglec-9 on immune cells in human tumors, freshly resected primary human tumors were processed by enzymatic digestion, followed by flow cytometric analysis. As shown in FIG. 1, in a representative lung adenocarcinoma sample, Siglec-9 was detected on the surface of tumor infiltrating macrophages and granulocytes, but not on T cells. Similar Siglec-9 expression profiles were observed in samples from colorectal, liver, ovary, and head and neck cancers. Further characterization of Siglec-9 myeloid cell expression revealed that Siglec-9 expression is highest on HLA-DRlo cells, which may be characterized as myeloid derived suppressor cells (MDSCs).

Example 2: Siglec-9 ECD Domains Show Binding and Efficient Recombinant Expression Siglec-9-hIgG1 truncation variants were evaluated for efficiency of expression and binding to A375 melanoma cells. The ECD of Siglec-9 consists of 3 domains: the ligand-binding IgV domain is located at the N-terminus, followed by the C2T1 and C2T2 domains. Of the three domains, the C2T2 domain is located closest to the plasma membrane. As shown in Table 1, only the Siglec-9 ECD-Fc variant containing all 3 domains was efficiently expressed in Expi293 cells. In order to detect Siglec-9-hIgG1 binding, A375 cells were incubated with 250 μg/ml of the Siglec-9 ECD-Fc variants for 2 hours on ice in the dark, followed by a 30 minute incubation with a fluorescently-conjugated anti-human IgG (Jackson Immunoresearch). Binding was evaluated by flow cytometry with a BD FACS Canto, and analyzed using FlowJo software. The data in Table 1 shows that the IgV domain is required for binding to A375 cells, consistent with the IgV domain functioning as the main ligand recognition domain in the Siglec-9 ECD.

TABLE 1

Expression and cell binding of Siglec-9 ECD-Fc variants

| Variant | Yield (mg) per 250 ml | Cell binding |
| --- | --- | --- |
| IgV-C2T1-C2T2-Fc | 37.6 | + |
| IgV-Fc | 0.2 | + |
| IgV-C2T1-Fc | 1.7 | + |
| C2T1-C2T2-Fc | 0.4 | − |

Example 3: Siglec9-Fc Fusion Protein Engineering: Homology Modeling

Siglec9-Fc fusion protein was engineered by creating a Siglec9-IgV homology model, enabling the design of mutations for improving solubility and rebalancing charge distribution. Structure-based protein homology modeling and stability calculations were used to design Siglec-9 variants with improved solubility and surface charge redistribution, utilizing the protein modeling and the protein design modules of MOE (Molecular Operating Environment, Chemical Computing Group, Montreal, Canada).

Briefly, a homology model of the Siglec9 IgV domain ("HM_S9") was created using the Protein Modeler application in MOE 2019.01 (Molecular Operating Environment (MOE). Montreal (QC, Canada): Chemical Computing Group ULC; 2019 January). The primary amino acid sequence of the Siglec9-IgV (SEQ ID NO: 7) was used as the query sequence and is described in FIG. 2. A homology search was performed and PDB_ID 1O7V (high resolution structure of Siglec-7) from the Protein Data Bank (www (dot) rcsb (dot) org/) was used as the template for the query, which is approximately 73% identical to the template. Energy minimization throughout the protein homology modeling was performed with the Amber10: EHT forcefield in MOE 2019.01 for generating a refined model.

Next, electrostatic and hydrophobic surface patches were calculated using the refined HM_S9 model to identify residues associated with potentially problematic protein-protein interactions. This in silico analysis can be used to predict reversible aggregation, which typically arises from relatively weak non-covalent interactions. Hydrophobic interactions may contribute to high affinity non-specific interactions between macromolecules (Wildman, S. A., Crippen, G. M.; Prediction of Physiochemical Parameters by Atomic Contributions; J. Chem. Inf. Comput. Sci. 39 (1999) 868-873). In addition, in many proteins including antibodies, electrostatic interactions have been implicated in forming self-associated aggregates (Sharp K., Honig B.; Electrostatic Interactions in Macromolecules: Theory and Applications. Ann. Rev. Biophys. Biophys. Chem. 19 (1990) 301-332).

Several positively charged and hydrophobic surface patches were identified. In silico site-directed mutagenesis was performed using the residue scanning function in MOE targeting hydrophobic patches, positively charged patches, or hydrophobic plus positively charged patches concurrently in the IGV domain. Single, double, triple, or quadruple mutations were introduced into each variant. The mutations were selected among alanine, arginine, asparagine, aspartic acid, glutamine, glutamic acid, glycine, histidine, lysine, serine, threonine, tyrosine, and valine.

Approximately 50,000 mutants were sampled and calculated for stability changes. Mutants to be constructed and tested further for functions, expression, solubility, and stability were selected based on improved stability, reduced positively charged patches, and reduced hydrophobic patches. The parental Siglec-9-Fc is shown in SEQ ID NO: 10. The sequence "WIYP" at amino acids 50-53 is replaced with the indicated four amino acids in S9.2-S9.7 (SEQ ID NOs: 11-16, respectively; DIEG, SEQ ID NO: 11; SIET, SEQ ID NO: 12; SIEP, SEQ ID NO: 13; DIEP, SEQ ID NO: 14; YQES, SEQ ID NO: 15; THET, SEQ ID NO: 16). In S9.8-S9.22 (SEQ ID NOs: 17-31), the indicated substitutions are made. See Table of Certain Sequences. (The numbering for the mutated residues is adjusted as a result of molecular modeling by MOE. The first amino acid of the mature polypeptide sequence (S of SKLL . . . ) is residue number 8.)

Example 4: Siglec9-Fc Fusion Protein Engineering: Replacing Loop Residues

A high-resolution crystal structure of Siglec-7 was compared to a Siglec-9 model (Alpheny, M. S., et al; High Resolution Crystal Structures of Siglec-7, Insights into Ligand Specificity in the Siglec Family; J. Biol. Chem. 278 (2003) 3372-3377). When compared to the negatively-charged Siglec-7 loop composed of VDSQTDSD (SEQ ID NO: 8), the isosteric Siglec-9 loop composed of SHGWIYPG (SEQ ID NO: 9) produces a larger hydrophobic surface. Therefore, a systematic in silico loop swapping protein engineering was applied; each amino acid of the Siglec-7 loop was either replaced by Siglec-9 residue or retained with Siglec-7 residue up to 8 residues, resulting in total 256 variants including 255 mutants and one wild-type variant. Stability change was calculated for all 256 variants. Mutants were selected for further characterization based on improved stability, reduced positively charged patches, and reduced hydrophobic patches. The amino acid sequences of these mutants, S9.23-S9.39, are shown in SEQ ID NOs: 32-39.

Example 5: Improved in Silico Properties of the Engineered Siglec9-IgV Variants

In silico biophysical properties including stability change (the more negative value, the more stable), area of hydrophobic protein patches, area of positively charged protein patches, area of negatively charged protein patches, isoelectric point, and net charges were calculated at pH7.4, 100 mM concentration of NaCl, and 298 K and compared with the parental construct. The results are shown in FIG. 3. Negative values in the "Stability Change" column indicate increased stability. The improvement of stability change is mostly due to redistribution of charge and reduction of exposed hydrophobic surface areas. Such changes usually result in increased protein expression and production.

Example 6: Siglec-9-Fc Binds to FcR-Negative Cell Lines with Moderate Affinity

The S9.1-hIgG1 variant (SEQ ID NO: 10) was used to evaluate Siglec-9-Fc binding to a panel of cancer cell lines.

S9.1-hIgG1 contains a native sequence Siglec-9 ECD, with deletion of amino acid residues LQSKATSGVTQG (SEQ ID NO: 147), which occur after the C2T2 domain and before the transmembrane domain, and with the signal sequence being cleaved during production. Titrating amounts of S9.1-hIgG1 were incubated with the cancer cell lines listed in Table 2 substantially as described in Example 2. FACS Kd was calculated substantially as described in Drake and Klakamp, *Journal of Immunological Methods*, 2007.

TABLE 2

Affinity of S9.1-hIgG1 for various cell lines

| Cell type | Tissue source | S9.1-hIgG1 Kd (nM) |
|---|---|---|
| A375 | Melanoma | 220 |
| A549 | Lung adenocarcinoma | 193 |
| K562 | Leukemia | 12.9 |
| 293T | Embryonic kidney | 175 |

As shown in Table 2, S9.1-hIgG1 bound with higher affinity to K562 leukemia cells compared to the other cancer cell lines. As K562 cells are derived from cells from the myeloid lineage, they express FcRs on the surface, while the other cancer cell lines do not. Therefore, and without being bound by theory, binding of S9.1-hIgG1 to both FcR and sialic acid on leukemia cells appears to result in a cooperative binding effect (see Example 7), compared to binding of S9.1-hIgG1 only to sialic acid on cancer cells that do not express FcRs. This may partially explain the enhanced affinity of S9.1-hIgG1 for K562 cells compared to the other cancer cells that were tested.

Example 7: Siglec-9-Fc Binds with High Affinity to Myeloid-Derived Suppressor Cells To examine Siglec-9-Fc binding on primary human cells, S9.A-mIgG1 was used to evaluate affinity of Siglec-9-Fc to myeloid-derived suppressor cells (MDSCs). S9.A-mIgG1 (SEQ ID NO: 43) contains the full length Siglec-9 ECD (amino acid residues 1-348 of SEQ ID NO: 1) fused via a seven amino acid linker to a murine IgG1 Fc domain, with the signal sequence being cleaved during production. MDSCs were generated substantially as follows: CD14+ monocytes were isolated from healthy human donors using a RosetteSep Human Monocyte Enrichment Cocktail kit (StemCell) and differentiated at 37° C. and 5% $CO_2$ for 7 days in RPMI media containing 10 ng/ml hGM-CSF (R&D) and 10 ng/ml hIL-6 (R&D). Cell binding was assessed by incubating MDSCs with titrating amounts of S9.A-mIgG1 for 2 hours on ice in the dark, followed by a 30 minute incubation with a fluorescently-conjugated anti-mouse IgG (Jackson Immunoresearch). Binding was evaluated by flow cytometry with a BD FACS Canto, and analyzed using FlowJo software. The variant S9.A-mIgG1, which has a murine Fc, was used, because anti-human detection on MDSCs results in prohibitively high background binding. As shown in Table 3, the calculated FACS Kd on MDSCs for S9.A-mIgG1 was in the low nM range for 3 independent donors, and was ~10-100 fold weaker on the reference cancer cell line, A549, which is a lung carcinoma epithelial cell line. These studies show that Siglec-9-Fc binds with higher affinity to myeloid cells, such as MDSCs, than to cancer cells. Accordingly, these studies provide further evidence for a cooperative binding mechanism, in which Siglec-9-Fc binds to both FcR and sialic acid on myeloid cells, compared to binding of Siglec-9-Fc only to sialic acid on cancer cells that do not express FcRs. This would explain the enhanced affinity of S9.A-mIgG1 for MDSCs compared to the A549 lung cancer cell line, which does not express FcRs.

Figure 15:
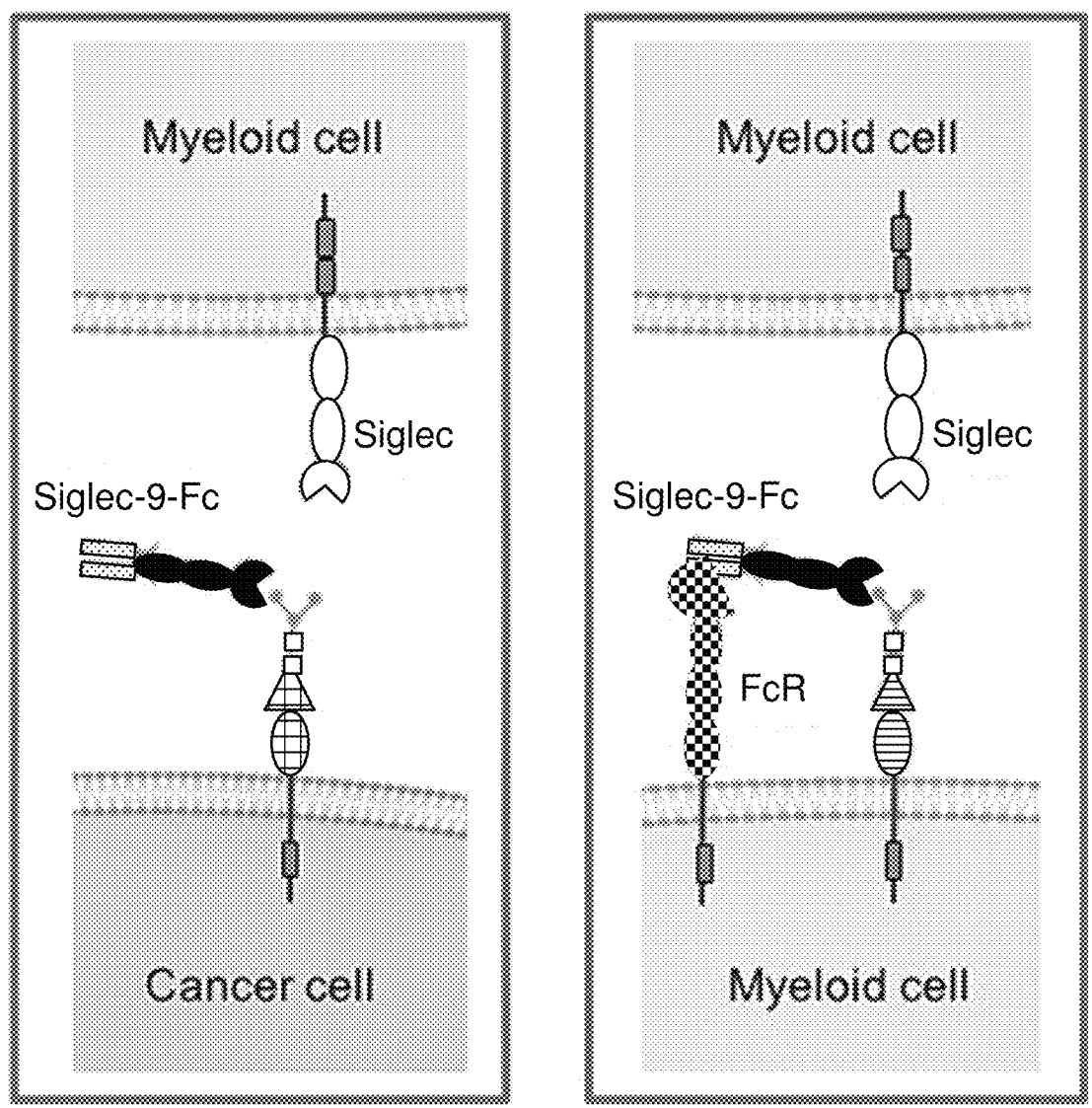
FIG. 15 shows an exemplary model of the mechanism of action of a Siglec-9-ECD-Fc fusion molecule (Siglec-9-Fc). Siglec-9-Fc binds to ligand (sialic acid) on cancer cells through its Siglec-9 ECD moiety (left panel). Based on the studies herein, and without being bound by theory, it is believed that Siglec-9-Fc binds to both FcR (e.g., FcγRIIA) and ligand (sialic acid) expressed on myeloid cells (right panel). Binding occurs through the Fc moiety and the Siglec-9 ECD moiety, respectively, of the Siglec-9-Fc molecule via a cooperative binding (or cis) interaction. Consequently, Siglec-9-Fc binds with higher affinity to myeloid cells compared to cells that do not express FcRs, resulting in preferential targeting to myeloid cells in vivo, and activation of myeloid cells.

FIG. 15 shows an exemplary model of the mechanism of action of a Siglec-9-ECD-Fc fusion molecule (Siglec-9-Fc). Siglec-9-Fc binds to ligand (sialic acid) on cancer cells through its Siglec-9 ECD moiety (left panel). Based on the studies herein, and without being bound by theory, it is believed that Siglec-9-Fc binds to both FcR and ligand (sialic acid) expressed on myeloid cells (right panel). Binding occurs through the Fc moiety and the Siglec-9 ECD moiety, respectively, of the Siglec-9-Fc molecule via a cooperative binding (or cis) interaction. Consequently, Siglec-9-Fc binds with higher affinity to myeloid cells compared to cells that do not express FcRs, resulting in preferential targeting to myeloid cells in vivo.

TABLE 3

Affinity of S9.A-mIgG1 for MDSCs from three donors and A549 cells

| Cell type | S9.A-mIgG1 Kd (nM) |
|---|---|
| MDSC donor #1 | 4.2 |
| MDSC donor #2 | 19.4 |
| MDSC donor #3 | 1.9 |
| A549 | 228 |

Example 8: Siglec-9-Fc Potently Repolarizes MDSCs

S9.A-hIgG1 (SEQ ID NO: 40) and S9.A-hIgG1 LALAPS (SEQ ID NO: 42) were evaluated for the ability to repolarize MDSCs. S9.A-hIgG1 (SEQ ID NO: 40) and S9.A-hIgG1 LALAPS (SEQ ID NO: 42) contain the full length Siglec-9 ECD (amino acid residues 1-348 of SEQ ID NO: 1) fused via a seven amino acid linker to a human IgG1 Fc domain, with the signal sequence being cleaved during production. For S9.A-hIgG1, the human IgG1 Fc domain is a native sequence hIgG1, and for S9.A-hIgG1 LALAPS, the human IgG1 Fc domain contains the "LALAPS" substitutions. As previously described, LALAPS substantially abolishes Fc-FcR interactions.

Human MDSCs were generated from CD14+ monocytes as described in Example 7, and were then incubated with 10 μg/ml S9.A-hIgG1 or S9.A-hIgG1 LALAPS for 48 hours at 37° C. and 5% $CO_2$. The supernatants were harvested and secreted chemokines were analyzed using the LEGENDplex Human Proinflammatory Chemokine Panel kit (Biolegend). As shown in Table 4, S9.A-hIgG1 potently repolarized MDSCs toward a pro-inflammatory phenotype, while S9.A-hIgG1 LALAPS was much less effective. This shows that FcR binding, in addition to ligand (sialic acid) binding, significantly enhances the ability of Siglec-9-Fc to repolarize MDSCs.

TABLE 4

Chemokine expression from MDSCs incubated with S9.A-hIgG1 or S9.A-hIgG1 LALAPS

| Analyte | S9.A-hIgG1 | S9.A-hIgG1 LALAPS | hIgG1 |
|---|---|---|---|
| CCL3 | *68780 ± 25341* | 355 ± 295 | 207 ± 176 |
| CCL4 | *16112 ± 4690* | 3505 ± 1371 | 792 ± 382 |
| CCL5 | *1081 ± 294* | 23 ± 8 | 16 ± 4 |

TABLE 4-continued

Chemokine expression from MDSCs incubated
with S9.A-hIgG1 or S9.A-hIgG1 LALAPS

| Analyte | S9.A-hIgG1 | S9.A-hIgG1 LALAPS | hIgG1 |
|---|---|---|---|
| CCL17 | *4585 ± 1429* | 401 ± 167 | 188 ± 41 |
| CXCL1 | *11801 ± 1235* | 1135 ± 282 | 154 ± 77 |
| CXCL9 | 306 ± 190 | 57 ± 26 | 68 ± 58 |
| IL-8 | *280552 ± 18324* | *181326 ± 36223* | 11551 ± 5418 |

The unit for Table 4 is pg/ml. The results are represented as mean±SEM, pooled from 4 donors. Italicized numbers indicate p<0.05 when comparing the Siglec-9-Fc variants to hIgG1 isotype control in a two-sided t-test.

Example 9: Siglec-9 Relieves MDSC-Mediated Suppression of T Cells

The effect of S9.1-hIgG1 (SEQ ID NO: 10) treatment was evaluated in a human MDSC-T cell co-culture system. Briefly, human MDSCs were generated as described in Example 7. Autologous CD8+ T cells were isolated from blood using a RosetteSep™ Human CD8+ T Cell Enrichment Cocktail kit (StemCell). MDSCs were treated for 48 hours with 10 µg/ml S9.1-hIgG1 or IgG control at 37° C. and 5% $CO_2$, followed by co-culture with autologous CD8+ T cells in the presence of Dynabeads® Human T-Activator CD3/CD28 at a ratio of 1:2:2 MDSC:T cells:Dynabeads®. In some conditions, CD8+ T cells incubated with CD3/CD28 Dynabeads® only were treated with S9.1-hIgG1. All cell conditions were cultured for 4 days at 37° C. and 5% $CO_2$, followed by quantification of IFNγ in the culture supernatant by ELISA (Thermo Fisher).

Figure 4:
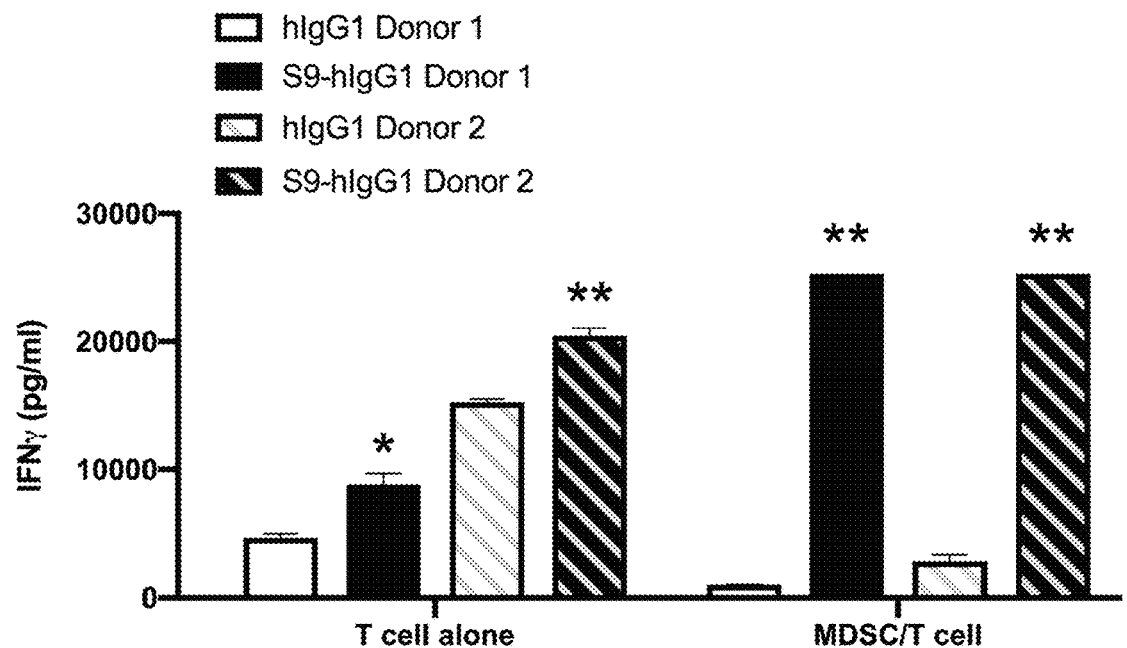
FIG. 4 shows IFNγ expression by T cells alone or co-cultured with myeloid-derived suppressor cells (MDSCs) contacted with S9.1-hIgG1 (S9-hIgG1), as described in Example 9.

As shown in FIG. 4, S9.1-hIgG1 (referred to as "S9-hIgG1" in FIG. 4) strongly relieved MDSC-mediated suppression of T cells. S9.1-hIgG1 also had an effect on CD8+ T cells cultured in the presence of CD3/CD28 Dynabeads® but not MDSCs. MDSCs treated with S9.1-hIgG1 cultured alone produced <20 pg/ml IFNγ (data not shown). Mean±SEM is shown. These studies show that while Siglec-9-Fc can enhance T cell activation in the absence of MDSCs, it can more potently enhance T cell activation in the presence of MDSCs by relieving myeloid cell immune suppressive signals, e.g., by blocking engagement of Siglec ligands on myeloid cells.

Example 10: Siglec-9-Fc, but not Siglec Antibodies, Relieves MDSC-Mediated Suppression of T Cells The ability of S9.A-hIgG1 (SEQ ID NO: 40) to relieve MDSC-mediated suppression of T cells was directly compared to a panel of functional anti-Siglec antibodies. MDSCs and autologous CD8+ T cells were prepared for co-culture as described in Example 9. MDSCs were treated with 15 µg/ml S9.A-hIgG1 or antibodies directed against Siglec-3, Siglec-7, or Siglec-9 that either induce target receptor downregulation or block cognate ligand binding, for 48 hours followed by co-culture with CD8+ T cells and CD3/CD28 Dynabeads® for 4 days. IFNγ was evaluated in the culture supernatant by ELISA.

Figure 5:
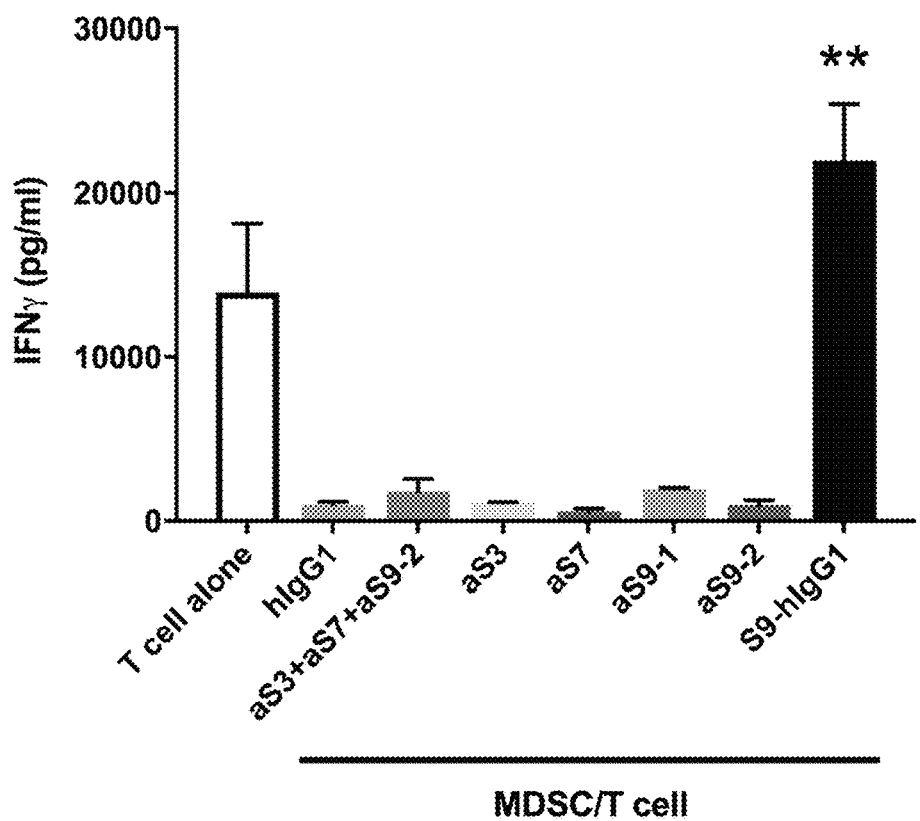
FIG. 5 shows IFNγ expression by T cells alone or co-cultured with MDSCs contacted with antibodies to Siglec-3 (aS3), Siglec-7 (aS7), Siglec-9 (aS9-1 and aS9-2), a combination of aS3, aS7, and aS9-2, or S9.1-hIgG1 (S9-hIgG1), as described in Example 10.

As shown in FIG. 5, anti-Siglec antibodies alone or in combination were unable to relieve MDSC-mediated suppression of T cells as effectively as S9.A-hIgG1. Mean±SEM is shown. aS9-1 and aS9-2 are two different Siglec-9 antibodies. p-value was determined by comparing S9.A-hIgG1 to the triple antibody combination condition. This study provides further evidence of the cooperative binding mechanism shown in FIG. 15. Siglec-9-Fc is capable of achieving this mechanism, whereas anti-Siglec antibodies, including anti-Siglec-9 antibodies, are not. Additionally, a commercially available human Siglec-9-Fc fusion protein was obtained (R&D Systems Catalog #1139-SL-050, "Recombinant Human Siglec-9 Fc Chimera Protein, CF," at www (dot) rndsystems (dot) com) and tested in the above assay. It did not show any significant activity (data not shown).

Example 11: Siglec-9-Fc with Intact FcR Binding Potently Relieves MDSC-Mediated Suppression of T Cells The potency of S9.1-hIgG1 (SEQ ID NO: 10) was compared to S9.A-hIgG1 LALAPS (SEQ ID NO: 42) in the human MDSC-T cell co-culture system. MDSCs and autologous CD8+ T cells were prepared for co-cultured as described in Example 9. MDSCs were treated with the indicated amounts of S9.1-hIgG1, 59.A-hIgG1 LALAPS, or isotype controls for 48 hours, followed by co-culture with CD8+ T cells and CD3/CD28 Dynabeads® for 4 days. IFNγ was evaluated in the culture supernatant by ELISA.

As shown in FIG. 6, S9.1-hIgG1, which has intact FcR engagement, is much more potent in relieving MDSC-mediated suppression of T cells compared to the LALAPS variant. The EC50 for S9.1-hIgG1 in this assay was calculated to be 17.5 nM, which is in the range of the FACS Kd on MDSCs described in Table 3. In addition, these results are consistent with the data in Table 4, which showed that Siglec-9-Fc with intact FcR engagement is more potent in repolarizing MDSCs as measured by chemokine production compared to a Siglec-9-Fc variant with the LALAPS mutation.

Example 12: Siglec-9-hIgG1 and Siglec-9-hIgG1 NSLF Repolarize MDSCs Equivalently in a Dose Dependent Manner A variant of Siglec-9-Fc containing the NSLF mutation in the Fc portion of the fusion protein was evaluated for the ability to repolarize human MDSCs. The NSLF mutation disrupts the interaction between human IgG1 Fc and human C1q (complement component 1 q) and human CD16/FcRIII, which induces antibody-dependent cellular cytotoxicity (ADCC). MDSCs were generated from CD14+ monocytes as previously described. On day 7, MDSCs were treated with the indicated amounts of S9.A-hIgG1 (SEQ ID NO: 40) or S9.A-hIgG1 NSLF (SEQ ID NO: 41) for 48 hours at 37° C. and 5% $CO_2$. The supernatants were harvested and secreted chemokines were analyzed using the LEGENDplex™ Human Proinflammatory Chemokine Panel kit (Biolegend).

FIG. 7 shows that S9.A-hIgG1 and S9.A-hIgG1 NSLF repolarized MDSCs equivalently, as demonstrated by a similar increase in the representative chemokines CCL5 and CCL17. These studies show that complement fixation and ADCC are not required for Siglec-9-Fc activity. Furthermore, the ability to use a hIgG1 containing NSLF to achieve the desired effects on myeloid cells reduces the chance of detrimental effects that might otherwise result from activation of complement and ADCC.

Example 13: Siglec-9-hIgG1 and Siglec-9-hIgG1 NSLF Increase CD86 Expression and Decrease CD163 Expression in MDSCs Human MDSCs were generated from CD14+ monocytes as previously described. On day 7, MDSCs were treated with the indicated amounts of S9.A-hIgG1 (SEQ ID NO: 40) or S9.A-hIgG1 NSLF (SEQ ID NO: 41) for 48 hours at 37° C. and 5% $CO_2$, after which the expression of CD86, a pro-inflammatory marker, and CD163, an M2 macrophage marker, was quantified using anti-CD86 antibody (clone IT2.2, Biolegend) and anti-CD163 antibody (clone GHI/61, BD).

Figure 8:
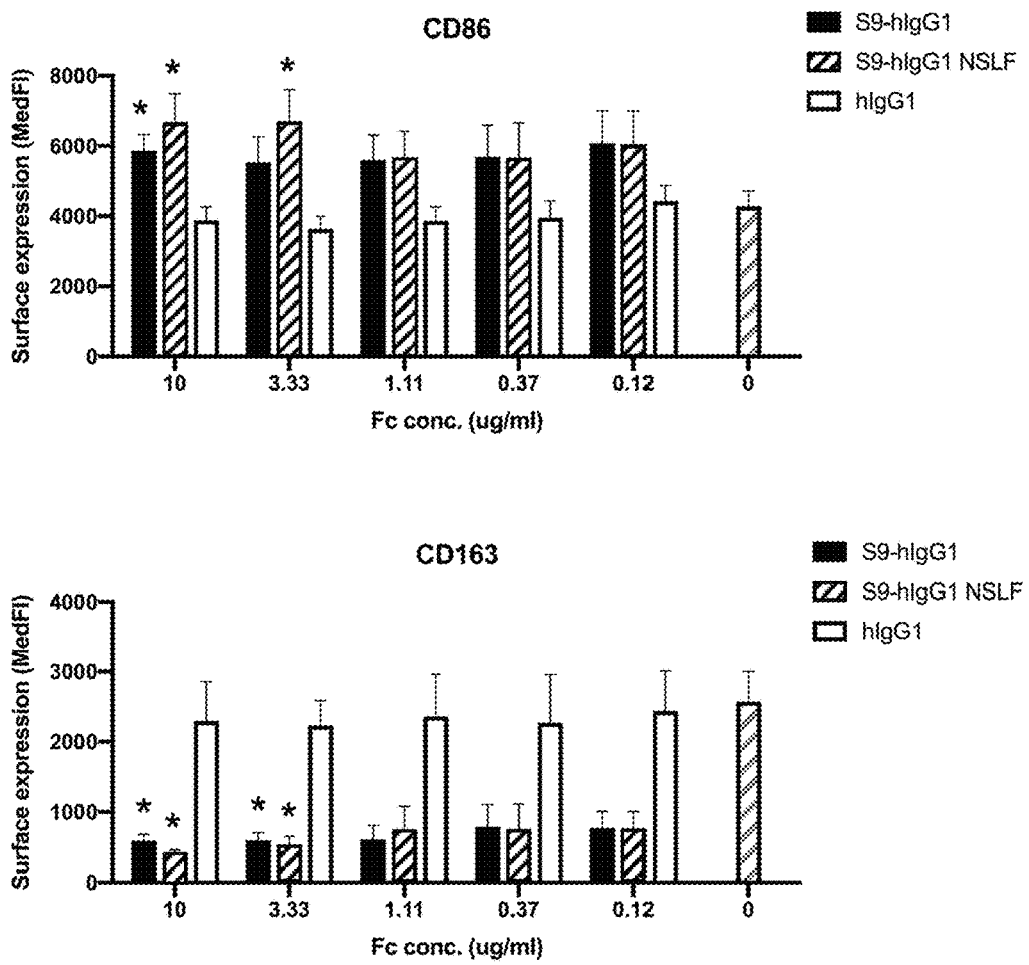
FIG. 8 shows CD86 (top) and CD163 (bottom) expression from MDSCs contacted with S9.A-hIgG1 (S9-hIgG1) or S9.A-hIgG1 NSLF (S9-hIgG1 NSLF), as described in Example 13.

As shown in FIG. 8, treatment with either S9.A-hIgG1 or S9.A-hIgG1 NSLF led to a dose dependent increase in CD86 and decrease in CD163, consistent with a repolarization of the MDSCs toward a pro-inflammatory phenotype (e.g., from an M2 immunosuppressive phenotype to an M1 activating phenotype). Mean±SEM is shown.

Example 14: Siglec-9-hIgG1 and Siglec-9-hIgG1 NSLF Repolarize Tumor Macrophages In Vivo in Humanized Mice The effect of Siglec-9-Fc treatment in vivo was evaluated using a humanized mouse model. Immunodeficient HuNOG-EXL mice that express human IL-3 and GM-CSF transgenes were engrafted with human CD34+ hematopoietic progenitor cells (Taconic) to effectively reconstitute the human immune response. The mice were subcutaneously implanted with $3 \times 10^6$ A375 human melanoma cells. 16 days later, when the tumors were approximately 300 $mm^3$, the mice were treated twice, 3 days apart, with an intraperitoneal (i.p.) injection of 10 mg/kg S9.1-hIgG1 (SEQ ID NO: 10), S9.A-hIgG1 NSLF (SEQ ID NO: 41), or hIgG1 isotype control. Tissue was analyzed 24 hours after the $2^{nd}$ dose.

Figure 9A:
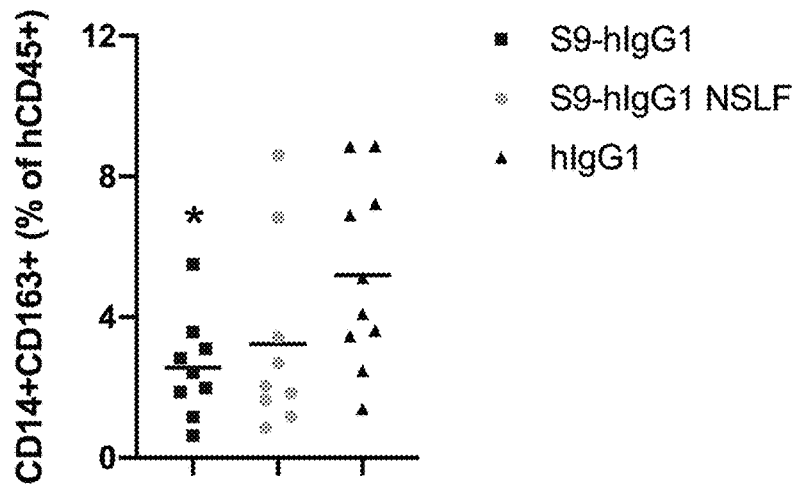
FIG. 9A-9C show the percentage of CD14+CD163+ macrophages relative to total CD45+ cells (9A), CD14+CD206+ macrophages relative to total CD45+ cells (9B), and surface expression of CD206 on CD14+ macrophages (9C) in mice treated with S9.1-hIgG1 (S9-IgG1), S9.A-hIgG1 NSLF (S9-hIgG1 NSLF), or hIgG1 isotype control, as described in Example 14.
Figure 9B:
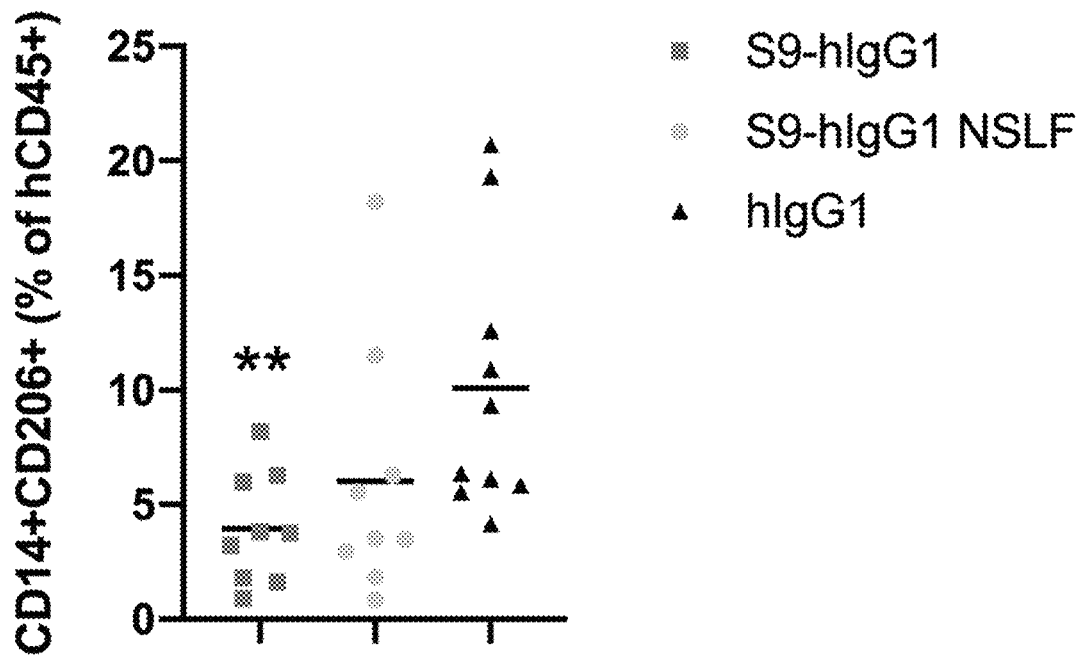
Figure 9C:
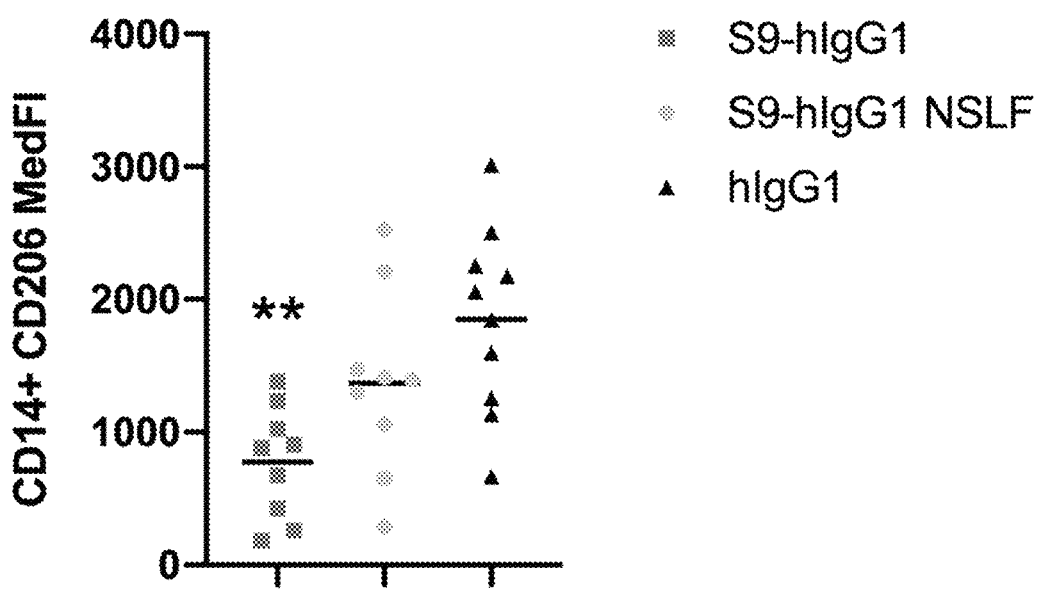

As shown in FIG. 9A-9C, in vivo treatment with either S9.1-hIgG1 or S9.A-hIgG1 NSLF confirmed the in vitro results observed with human MDSCs. The percentages of M2-like CD14+CD163+ macrophages relative to human CD45+ cells were decreased in the tumors of Siglec-9-Fc treated mice compared to isotype controls. See FIG. 9A. (S9.1-hIgG1 generated a more robust in vivo effect than S9.A-hIgG1 NSLF in the experiment shown in FIG. 9A; however, S9.A-hIgG1 NSLF generated a more robust in vivo effect than S9.1-hIgG1 in a repeated experiment (data not shown).) M2 macrophages identified by the surface marker CD206 were also reduced in tumors of mice treated with Siglec-9-Fc. See FIG. 9B. Further, the surface expression of CD206 on CD14+ macrophages in the tumor was decreased. See FIG. 9C. With respect to FIG. 9B and FIG. 9C, S9.1-hIgG1 generated a more robust in vivo effect than S9.A-hIgG1 NSLF. Mean is shown in each panel of FIG. 9.

Example 15: Siglec-9-Fc does not Result in Blood Cell Depletion In Vivo in Humanized Mice Tumor-bearing HuNOG-EXL mice treated with S9.1-hIgG1 or S9.A-hIgG1 NSLF were also evaluated for blood cell depletion with a standard complete blood count. Blood was collected on the day of tissue harvest (24 hours after the second 10 mg/kg dose) via cardiac puncture and placed into heparin-containing blood collection tubes.

Figure 10:
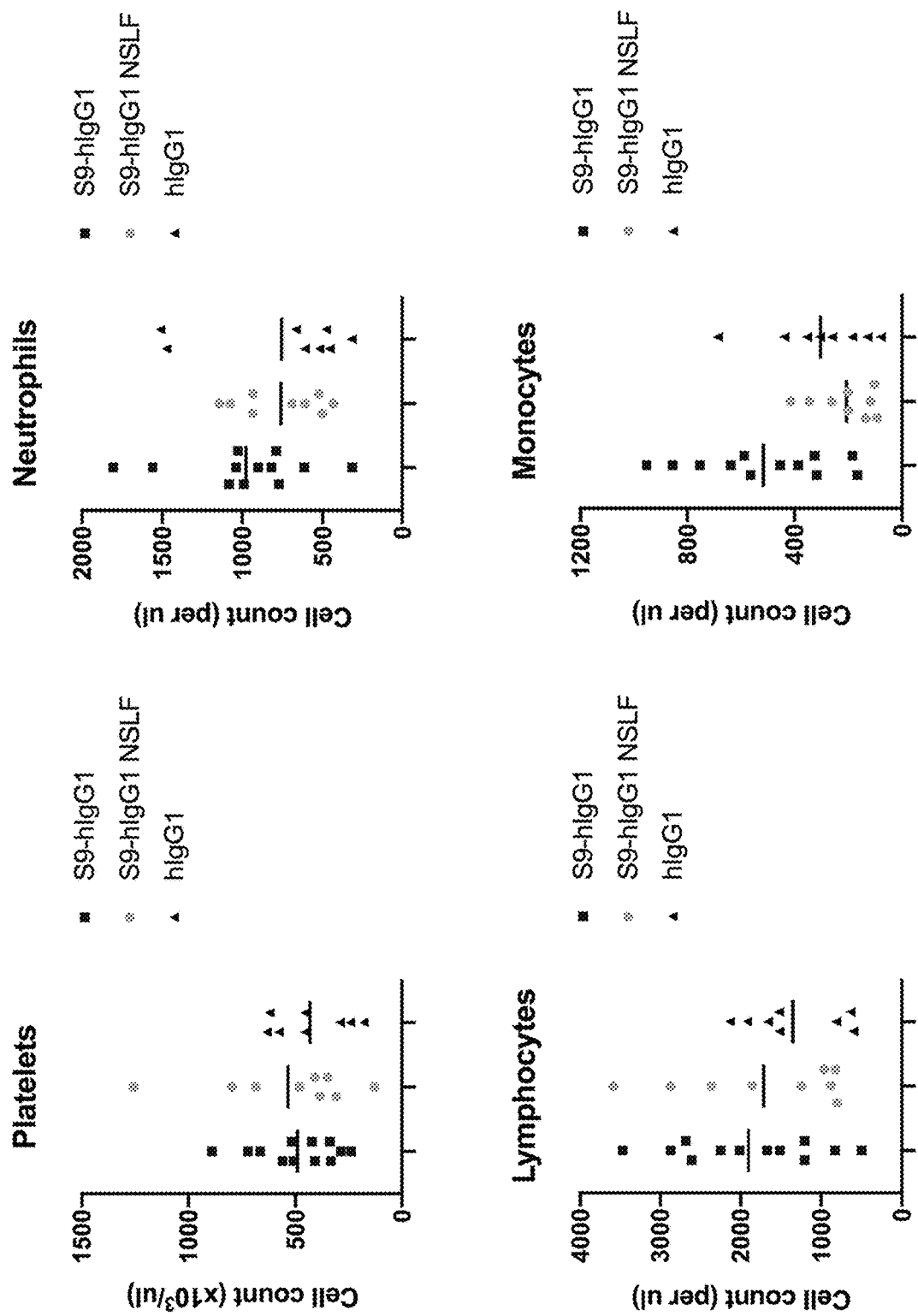
FIG. 10 shows number of platelets, neutrophils, lymphocytes, and monocytes per microliter of blood in mice treated with S9.1-hIgG1 (S9-hIgG1), S9.A-hIgG1 NSLF (S9-hIgG1 NSLF), or hIgG1 isotype control, as described in Example 15.

FIG. 10 shows that neither S9.1-hIgG1 nor S9.A-hIgG1 NSLF resulted in significant changes in blood cell composition compared to isotype controls. (Mean is shown.) Although S9-hIgG1 engages CD16/FcRIII and is therefore capable of inducing ADCC, surprisingly no depletion of major blood cell types was observed.

Example 16: Siglec-3/7/9 BAC Transgenic Mice are Less Responsive to Anti-PD-L1 Treatment in the Context of MC38 Tumor Growth Bacterial artificial chromosome (BAC) transgenic C57BL/6 mice expressing human Siglec-3, Siglec-7, and Siglec-9 were created and MC38 syngeneic tumor growth was evaluated in these mice. S3/7/9 BAC mice were implanted subcutaneously with MC38 cells (murine colon adenocarcinoma cell line), and once tumors reached an average of 100 $mm^3$, the mice were treated i.p. with 3 mg/kg anti-PD-L1 antibody (BM1) 2 times per week for 3 weeks.

Figure 11:
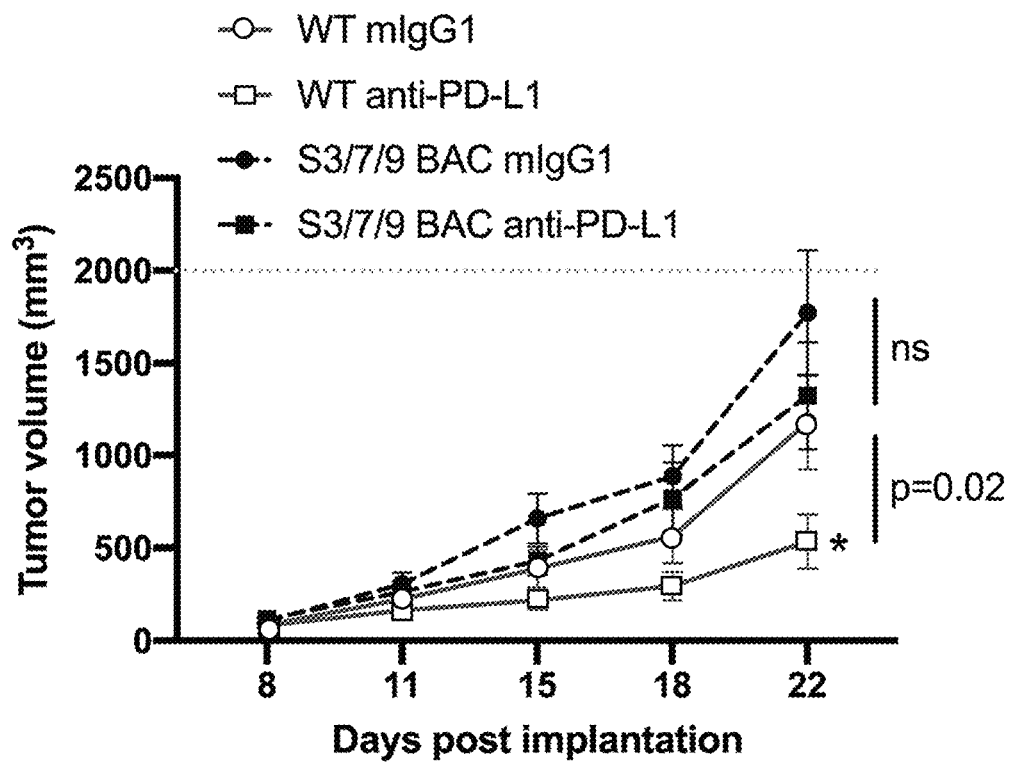
FIG. 11 shows tumor growth of in transgenic C57BL/6 mice expressing human Siglec-3, Siglec-7, and Siglec-9 (S3/7/9 BAC), implanted with MC38 cells, and treated with anti-PD-L1 antibody, as described in Example 16.

As shown in FIG. 11, S3/7/9 BAC mice were less responsive to anti-PD-L1 treatment compared to WT controls. Mean±SEM is shown. These studies show that blocking Siglec protein function may improve response to treatments that inhibit PD-1 or PD-L1, such as anti-PD-1 or anti-PD-L1 antibody therapy.

Example 17: Siglec-9-Fc Monotherapy Delays MC38 Tumor Growth

Siglec-9-mIgG2a (S9.B-mIgG2a; SEQ ID NO: 44) was produced to analyze the effect of Siglec-9-Fc in a mouse syngeneic tumor model with an Fc that would maximize an Fc-FcR interaction. S3/7/9 BAC mice were implanted subcutaneously with MC38 cells. Once tumors reached an average of 100 $mm^3$, the mice were treated i.p. with 10 mg/kg S9.B-mIgG2a 2 times per week for 3 weeks.

Figure 12:
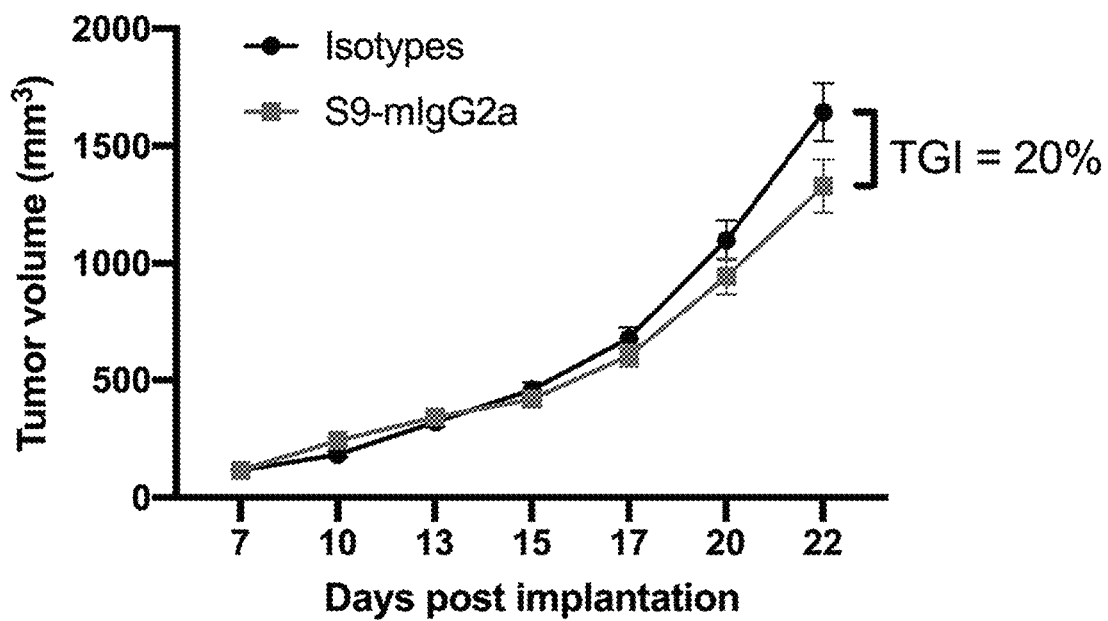
FIG. 12 shows tumor growth of in transgenic C57BL/6 mice expressing human Siglec-3, Siglec-7, and Siglec-9, implanted with MC38 cells, and treated with S9.B-mIgG2a (S9-mIgG2a), as described in Example 17.

As shown in FIG. 12, S9.B-mIgG2a delays MC38 tumor growth compared to isotype control, with 20% tumor growth inhibition at day 22 after implantation. Mean±SEM is shown.

Example 18: Siglec-9-Fc Combines with Anti-PD-L1 to Reduce MC38 Tumor Growth The S3/7/9 BAC mice were implanted subcutaneously with MC38 cells. Once tumors reached an average of 100 $mm^3$, the mice were treated i.p. with 10 mg/kg S9.B-mIgG2a and 3 mg/kg anti-PD-L1 antibody 2 times per week for 3 weeks.

Figure 13:
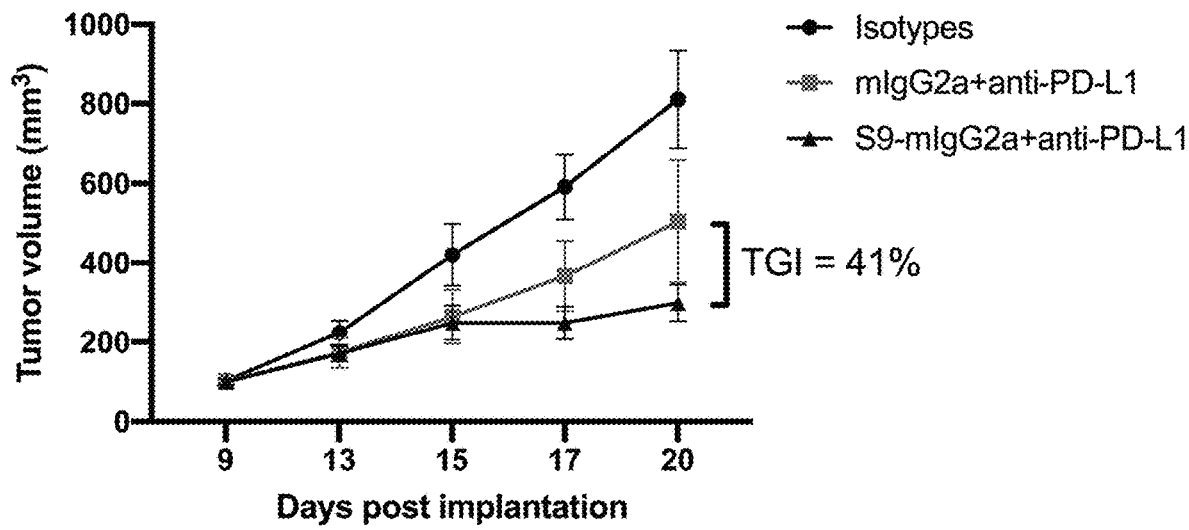
FIG. 13 shows tumor growth of in transgenic C57BL/6 mice expressing human Siglec-3, Siglec-7, and Siglec-9, implanted with MC38 cells, and treated with anti-PD-L1 antibody or the combination of S9.B-mIgG2a (S9-mIgG2a) and anti-PD-L1 antibody, as described in Example 18.

As shown in FIG. 13, the combination of Siglec-9-Fc with anti-PD-L1 antibody decreased MC38 tumor growth to a greater extent than anti-PD-L1 antibody treatment alone. At day 20 after implantation, 41% tumor growth inhibition was achieved compared to anti-PD-L1 antibody monotherapy. Mean±SEM is shown. These studies show that the combination of Siglec-9-Fc with a PD-1 or PD-L1 inhibitor, such as an anti-PD-1 or anti-PD-L1 antibody, may improve anti-tumor response.

Example 19: Siglec-9-Fc can Block Cell Binding of Multiple Siglec Family Members Human MDSCs were generated from CD14+ monocytes as previously described. On day 7, MDSCs were first incubated with titrating amounts of S9.1-hIgG1 for 20 minutes on ice in the dark followed by incubation with the indicated Siglec family members as mouse IgG1 fusion proteins for an additional 2 hours on ice in the dark. Binding was detected with a fluorescently-conjugated anti-mouse IgG (Jackson Immunoresearch) and analyzed by flow cytometry. Cell binding of each Siglec family member was normalized to non-blocking control (no S9.1-hIgG1 added).

Figure 14:
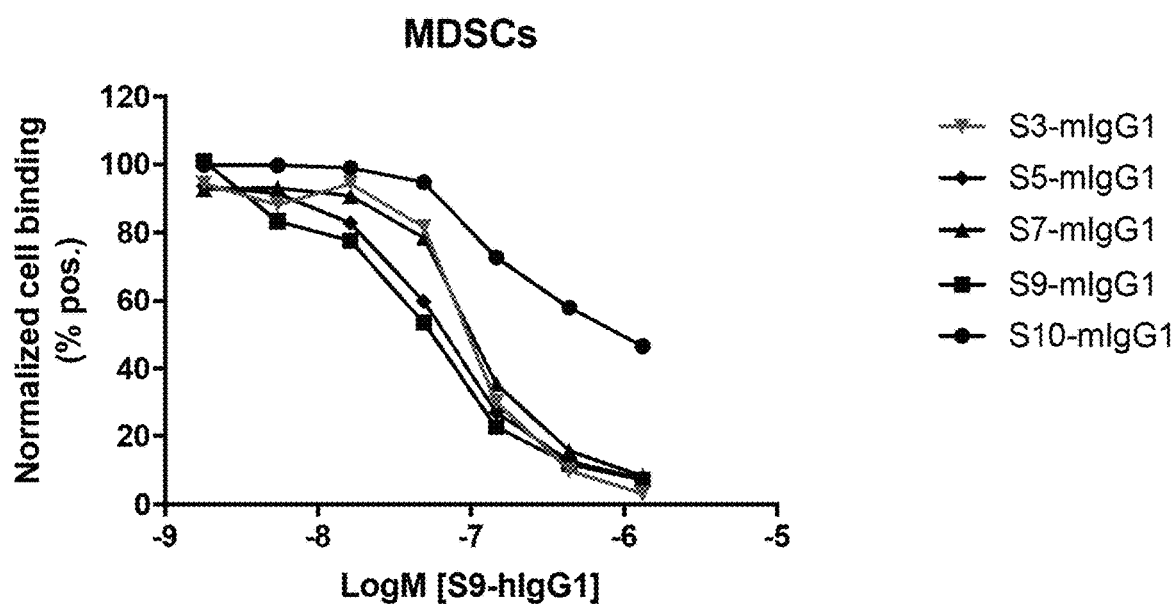
FIG. 14 shows binding of Fc fusions comprising the extracellular domains (ECDs) of Siglec-3 (S3-mIgG1), Siglec-5 (S5-mIgG1), Siglec-7 (S7-mIgG1), Siglec-9 (S9-mIgG1), and Siglec-10 (S10-mIgG1) to the surface of MDSCs in the presence of increasing concentrations of S9.1-hIgG1, as described in Example 19.

As shown in FIG. 14, S9.1-hIgG1 blocked binding of Siglec-3, Siglec-5, Siglec-7, Siglec-9, and Siglec-10 to the surface of MDSCs. These studies show that Siglec-9-Fc is advantageous in being a potent inhibitor of the activity of multiple Siglec proteins.

Figure 16A:
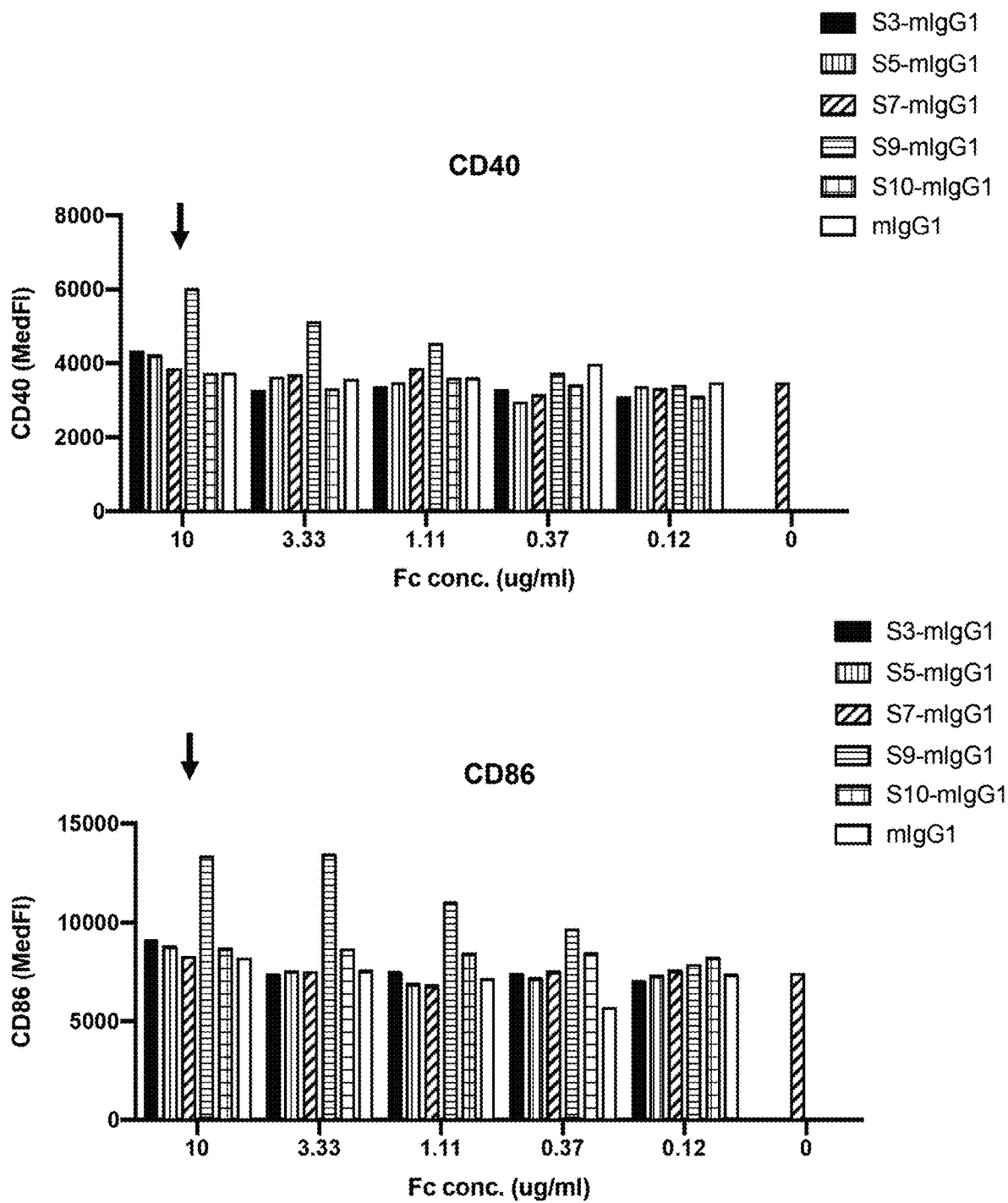
FIG. 16A and FIG. 16B show that S9.A-mIgG1 (S9-mIgG1) uniquely repolarizes MDSCs compared to other Siglec-Fc fusions, as described in Example 19. Each set of bars is, from left to right, S3-mIgG1, S5-mIgG1, S7-mIgG1, S9-mIgG1, S10-mIgG1, and mIgG1.
Figure 16B:
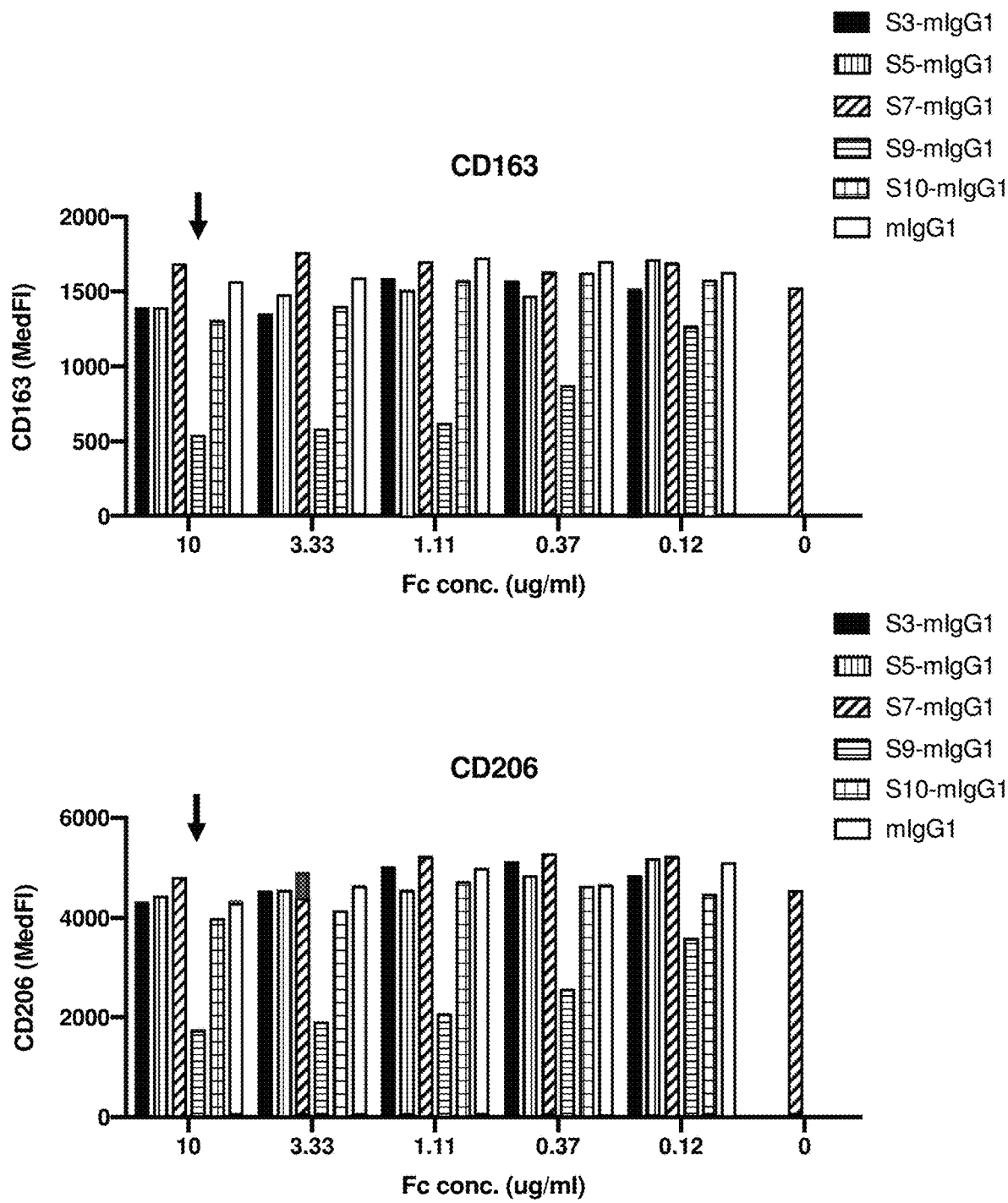

Repolarization experiments similar to those described in Examples 13 and 14 were performed using S.9A-mIgG1 and other Siglec protein-mIgG1 Fc domain fusions. As shown in FIG. 16A and FIG. 16B, Siglec-9-Fc uniquely repolarizes MDSCs compared to other Siglec-Fc fusions. CD40 and CD86 markers were increased, and CD163 and CD206 were decreased, indicating repolarization of MDSCs to a more pro-inflammatory phenotype.

Example 20: Analysis of Siglec-9-Fc Variants for Stability, Binding Affinity, Function, and Pharmacokinetic Properties Siglec-9-Fc variants are evaluated for stability with a protein thermal shift assay and extended incubation at 40° C. For the thermal shift assay, a melting temperature is determined using a real-time PCR machine. The binding affinity of the Siglec-9-Fc variants is measured by flow cytometry on A375 human melanoma cells, as described in Example 2. Biological function is assessed as the ability to relieve MDSC-mediated suppression in the MDSC-T cell co-culture assay, as described in Example 9. Pharmacokinetic (PK) properties are evaluated in vitro using an extracellular matrix binding assay with Matrigel plates, or in vivo with a standard PK assessment in mice.

Example 21: Evaluation of Pharmacodynamic Markers in Humanized Mice after Treatment with Siglec-9-Fc Humanized mice are generated as described in Example 14. These mice are subcutaneously implanted with 3×10$^6$ A375 human melanoma cells. 2-3 weeks later, when the tumors are approximately 300 mm$^3$, the mice are treated twice, 3 days apart, with an i.p. injection of 10 mg/kg Siglec-9-Fc or hIgG1 isotype control. Tissue is analyzed 24 hours after the 2$^{nd}$ dose. A pharmacodynamic (PD) effect is evaluated in the serum using LEGENDplex (Biolegend) cytokine and chemokine panel kits or a standard sandwich ELISA. Separately, human CD45+ cells in spleen and tumor are isolated using human CD45 MicroBeads (Miltenyi) and a transcriptional expression profile are generated using a Nanostring Myeloid Innate Immunity Panel.

Example 22: Analysis of a Combination Effect of Siglec-9-Fc with Anti-PD-L1 or Anti-TRP1 in Syngeneic Tumor Models Studies Syngeneic tumor cell lines are injected intravenously or implanted subcutaneously in S3/7/9 BAC mice. In the subcutaneous setting, once tumors reach an average of 100 mm$^3$, mice are treated i.p. with 10 mg/kg Siglec-9-Fc alone or in combination with 3 mg/kg anti-PD-L1 antibody 2 times per week for 3 weeks. Tumor growth is measured 2-3 times per week with calipers. The experimental endpoint is 50 days or when tumors reach 2000 mm$^3$. Reduced tumor growth, increased survival, greater T cell influx in tumors, and reduced CD163 or CD206 on tumor macrophages are some of the indicators of an anti-cancer effect of Siglec-9-Fc.

In the intravenous setting, B16F10 mouse melanoma cells are injected via the tail vein. 24 hours after implantation, mice are treated i.p. with an anti-TRP1 antibody, which recognizes a tumor antigen highly expressed on B16F10 cells and leads to tumor cell death via antibody-dependent cellular cytotoxicity (ADCC) and antibody-dependent cellular phagocytosis (ADCP). Twice per week until the end of the study, mice will also be treated i.p. with Siglec-9-Fc alone or in combination with anti-TRP1 antibody. The typical study duration is approximately 2 weeks. At the end of the study, lungs from the mice are harvested and tumor nodules are counted. A reduction in tumor nodules would be indicative of an anti-cancer effect with Siglec-9-Fc treatment.

Example 23: Effect of Siglec-9-Fc on Macrophage Cell Surface Markers

Myeloid cells in both the CNS and in peripheral organs are inherently plastic in their phenotype and function. This can be modeled by macrophages in vitro, which can be divided into M1 and M2 type macrophages, showing differing phagocytic and inflammatory potentials, phenotypes, and activities. In peripheral organs, macrophages associated with the M1 phenotype are thought to be more pro-inflammatory and anti-microbial, while M2-like macrophages are more homeostatic and anti-inflammatory. Within the CNS, microglia in homeostatic conditions also express M2 markers such as CD200R, CD163, suggesting regulatory functions in this cell type.

The effect of Siglec-9-Fc on various M1 and M2 macrophage cell surface markers is examined as follows. Human primary macrophages are treated with Siglec-9-Fc (e.g., 10 μg/ml) in complete RPMI1640 for 48 hours. The cells are then harvested and subjected to flow cytometry, using antibodies specific for M1 markers (such as CD16, MHC Class II, CD86), M2 markers (such as CD200R, Dectin-1, CD163), and a pan-macrophage marker including CD14 and others.

Example 24: Sialic Acid Expression on Tumor Cells

Figure 17:
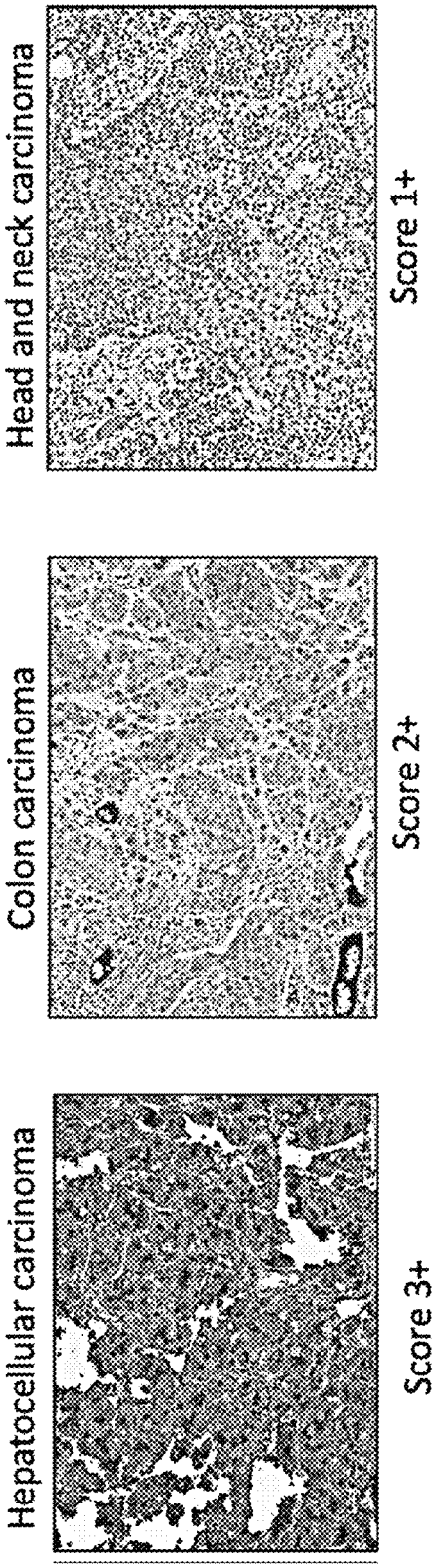
FIG. 17 shows detection of sialic acid expression on tumor samples by immunohistochemistry (IHC).

Expression of sialic acid on various tumor types Fc was assessed by immunohistochemistry. A tumor multi-array (Pantomics) containing human samples of adrenal, bladder, breast, bone, brain, esophageal, stomach, small intestine, colon, rectal, renal, liver, lung, lymphoma, ovarian, pancreatic, prostate, skin, testicular, thyroid, and uterine cancers was stained with 0.1 μg/ml S9.A-mIgG1 and visualized by colorimetric detection. Tumor samples were scored qualitatively based on intensity and prevalence of staining (1+ low intensity and/or prevalence, 2+ medium intensity or prevalence, and 3+ high intensity or prevalence) as shown in FIG. 17. Scores across multiple tumor types are summarized in Table 5.

TABLE 5

Sialic acid staining intensity in various human cancers

| Organ Site | Staining Intensity |
|---|---|
| Adrenal cancer | 3+ |
| Bladder cancer | 2+ to 3+ |
| Breast cancer | 2+ to 3+ |

TABLE 5-continued

Sialic acid staining intensity in various human cancers

| Organ Site | Staining Intensity |
|---|---|
| Bone cancer | 2+ |
| Brain cancer | 2+ to 3+ |
| Esophageal cancer | 2+ |
| Stomach | 2+ |
| Small intestine cancer | 2+ |
| Colon cancer | 2+ |
| Rectal cancer | 2+ |
| Renal cancer | 2+ |
| Liver cancer | 2+ to 3+ |
| Lung cancer | 2+ to 3+ |
| Lymphoma | 2+ to 3+ |
| Head and neck cancer | 1+ to 2+ |
| Ovarian cancer | 2+ to 3+ |
| Pancreatic cancer | 2+ |
| Prostate cancer | 2+ to 3+ |
| Skin cancer | 2+ |
| Testicular cancer | 1+ to 2+ |
| Thyroid cancer | 2+ |
| Uterus cancer | 2+ |

Binding of Siglec-9-Fc was observed across all tumor types, indicating the presence of cells that express sialic acid in the tumor samples. Therefore, these tumor types can be targeted by Siglec-9-Fc. Tumor types that achieve staining intensity of 2+ or greater may show more effective targeting of Siglec-9-Fc.

Example 25: Binding of Siglec-9-Fc Variants to Tumor Cells

Variants of S9.1 Fc were expressed and tested for binding to tumor cells and functional activity on MDSCs, using methods similar to those described in Example 6 (binding) and Example 13 (MDSC activity/marker expression). The variants were also tested for monomer content using size exclusion chromatography and for stability with a protein thermal shift assay and extended incubation at 40° C. For the thermal shift assay, melting temperature was determined using real-time PCR.

Figure 19C:
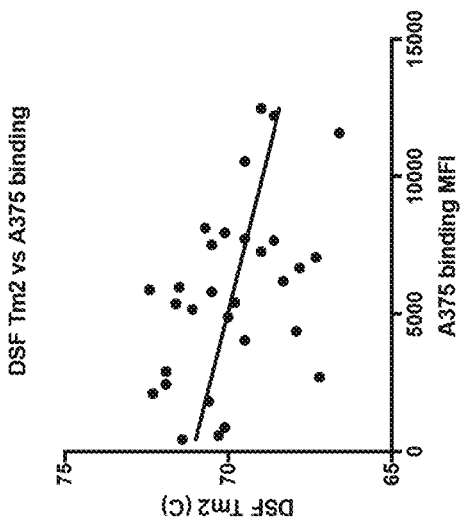
FIG. 19A-19C shows the correlation between CD86 induction in an MDSC assay versus A375 tumor cell binding (19A), correlation between production yield and A375 tumor cell binding (19B), and correlation between stability and A375 tumor cell binding (19C) for various Siglec-9-Fc variants.
Figure 19B:
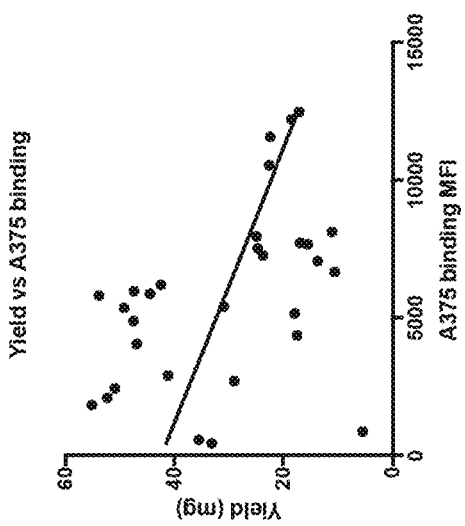
Figure 19A:
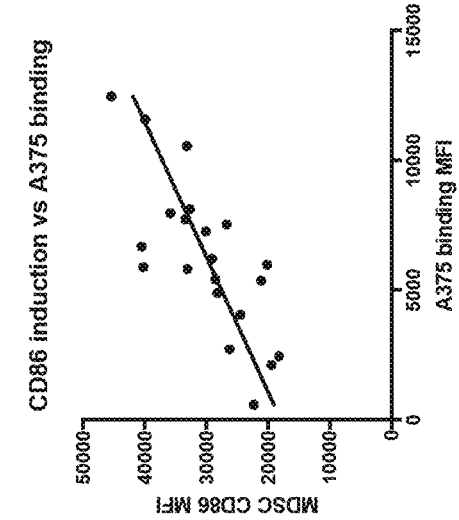

The data are summarized in FIG. 18. Variants of S9.1 Fc displayed reduced binding to A375 tumor cells and reduced functional activity on MDSCs, as measured by induction of CD86 or downregulation of CD163. A correlation analysis showed that binding to tumor cells directly correlated with induction of CD86 (FIG. 19A). A similar trend was observed for CD163 (data not shown). Variants of S9.1 Fc generally had a neutral or positive impact on the production yield and stability of the protein. However, increases in yield or thermal stability correlated inversely with binding to tumor cells (FIG. 19B, FIG. 19C). These data demonstrate that certain variants of S9.1 Fc improved expression or protein stability, but reduced pharmacological potency.

Example 26: Siglec-9-Fc Reduces Lung Nodules in an Intravenous Tumor Model of Metastasis In order to the analyze the effect of Siglec-9-mIgG2a in an intravenous tumor setting, B16F10 mouse melanoma cells were injected via the tail vein into S3/7/9 BAC or WT mice. 24 hours after implantation, all mice were treated i.p. with 27 µg anti-TRP1, which recognizes a tumor antigen highly expressed on B16F10 cells and leads to tumor cell death via antibody-dependent cellular cytotoxicity (ADCC) and anti- body-dependent cellular phagocytosis (ADCP). In addition, starting 24 hours after implantation, mice were treated i.p. once every 3 days with either 10 mg/kg S9.B-mIgG2a or mIgG2a isotype control until the end of the study. 15 days after implantation, lungs from the mice were harvested and tumor nodules were counted.

Figure 20:
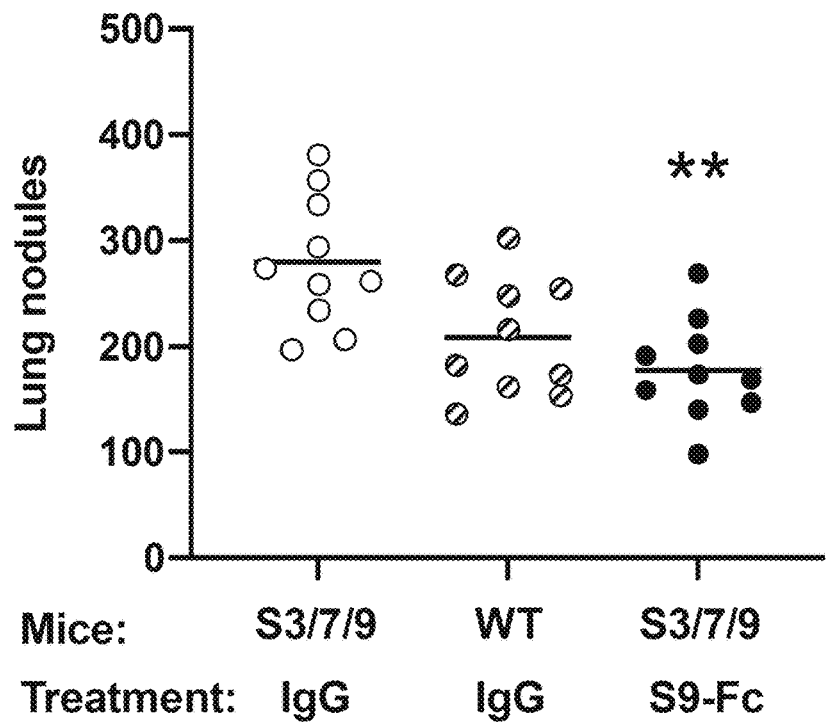
FIG. 20 shows reduction in lung nodules in S3/7/9 BAC mice injected intravenously with B16F10 mouse melanoma cells and treated with S9.B-mIgG2a (S9-Fc) compared to S3/7/9 BAC mice injected intravenously with B16F10 mouse melanoma cells and treated with isotype control.

As shown in FIG. 20, S3/7/9 BAC mice treated with S9.B-mIgG2a (S9-Fc) had a significant reduction in lung nodules compared to S3/7/9 BAC mice treated with isotype control. Mean is shown. **p<0.01, two-sided t-test. These results suggest that Siglec-9-Fc may be efficacious in treating metastatic cancer. Moreover, the results also suggest that Siglec-9-Fc enhances the ADCC and/or ADCP activity of anti-TRP1.

Example 27: Siglec-9-Fc Monotherapy Significantly Inhibits E0771 Tumor Growth

The ability of Siglec-9-Fc to reduce solid tumor growth was tested in the E0771 syngeneic breast cancer model. This tumor model is relatively rich in myeloid cell content. S3/7/9 BAC mice were implanted subcutaneously with E0771 cells. Once tumors reached an average of 100 mm³, the mice were treated i.p. with 20 mg/kg S9.B-mIgG2a or isotype control 2 times per week for 3 weeks.

Figure 21:
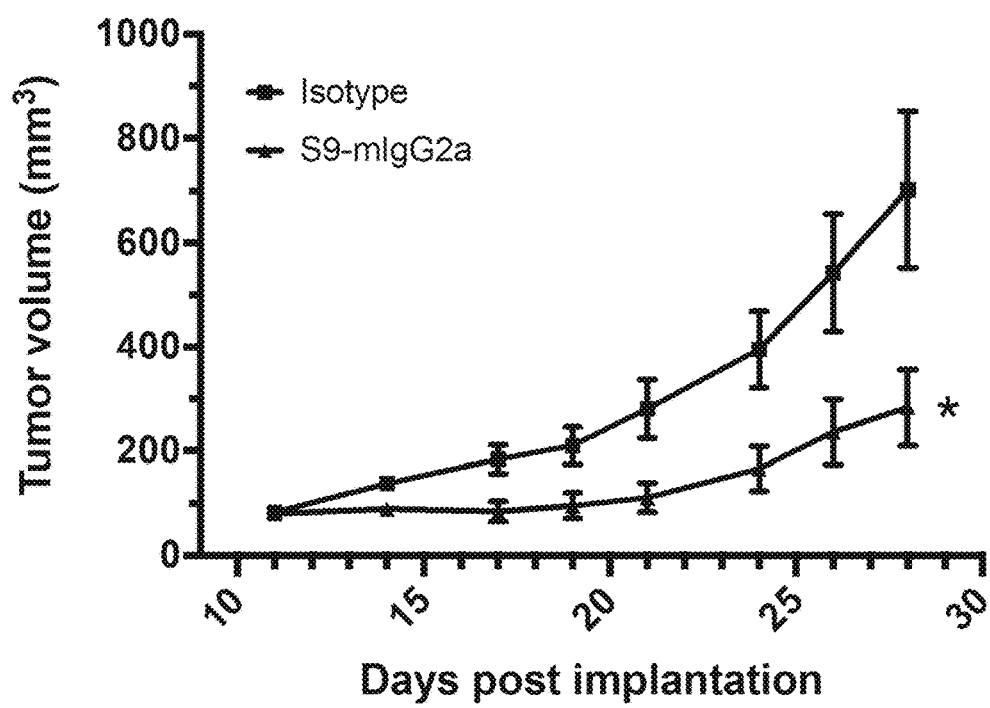
FIG. 21 shows that S9.B-mIgG2a monotherapy inhibits tumor growth in a E0771 syngeneic breast cancer model compared to isotype control.

As shown in FIG. 21, S9.B-mIgG2a monotherapy inhibits tumor growth compared to isotype control. Mean±SEM is shown. *p<0.05, two-sided t-test at all time points shown. These data indicate that Siglec-9-Fc has efficacy in treating tumors in which myeloid cells are present.

Figure 22A:
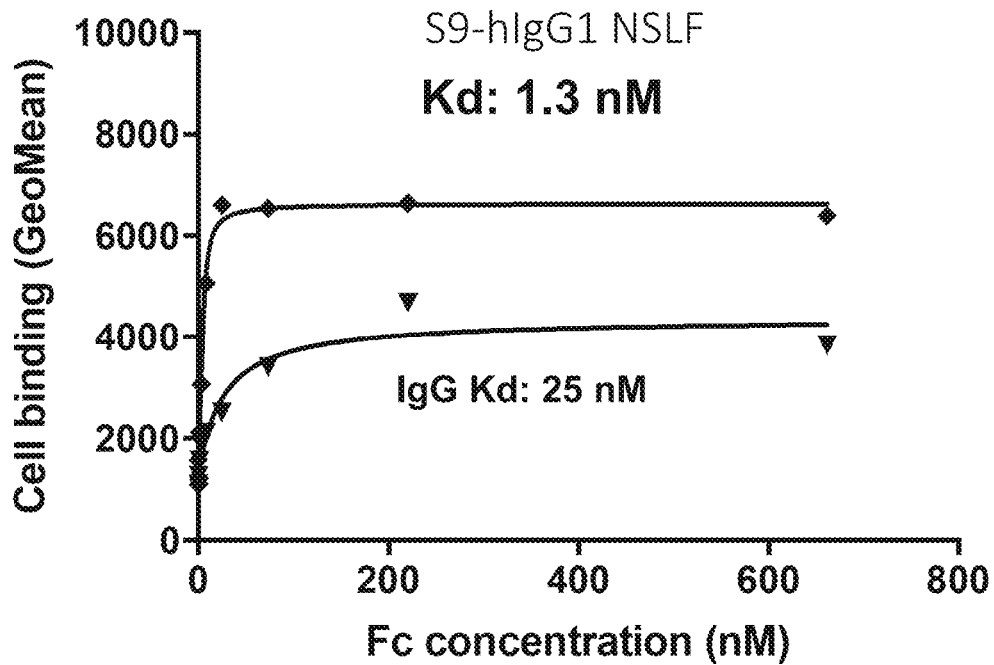
FIG. 22A-22C show results of flow cytometry experiments to determine the effect of Fcγ receptor engagement on binding of Siglec-9-Fc to myeloid-deprived suppressor cells (MDSCs).
Figure 22B:
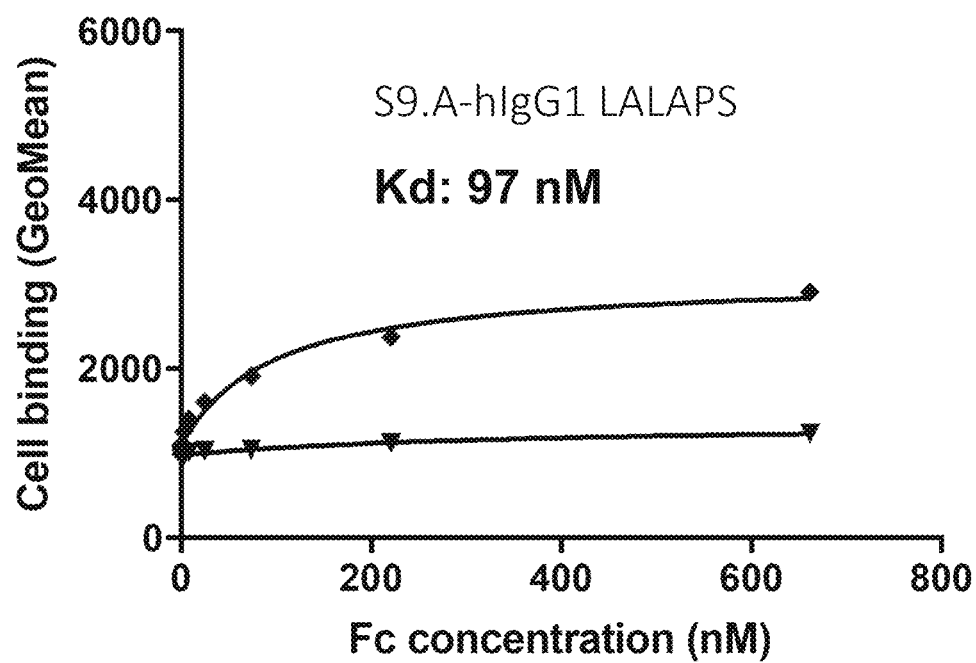
Figure 22C:
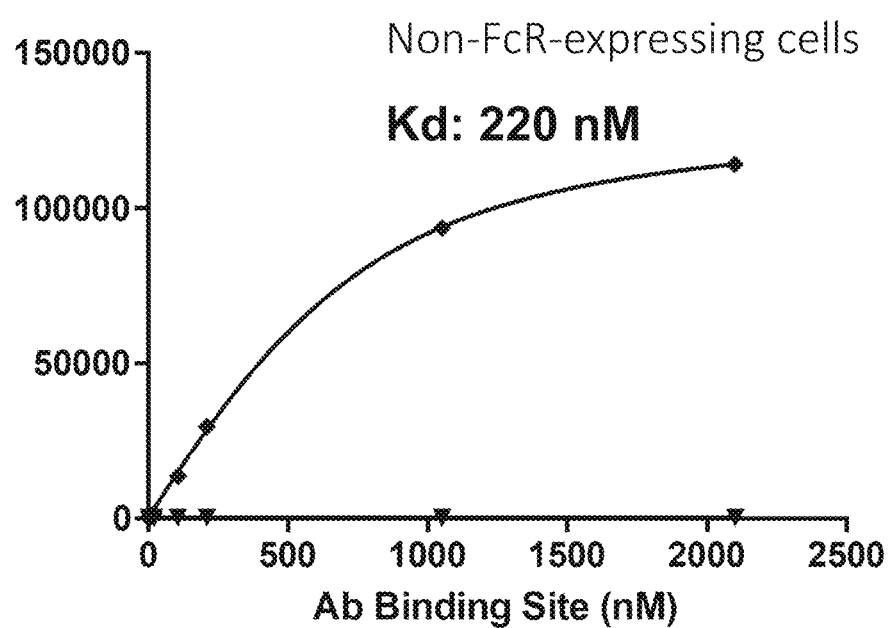

Example 28: Siglec-9-hIgG1 NSLF Displays Cooperative Binding Between Sialic Acid and Fcγ Receptors To determine the effect of Fcγ receptor engagement on binding of Siglec-9-Fc, S9-hIgG1 NSLF (SEQ ID NO: 48, with signal sequence cleaved during production) and S9.A-hIgG1 LALAPS (SEQ ID NO: 42, with signal sequence cleaved during production) were tested for binding to MDSCs. MDSCs were generated as previously described and incubated with titrating amounts of S9-hIgG1 NSLF for 2 hours on ice in the dark, followed by a 30-minute incubation with a fluorescently-conjugated anti-mouse IgG (Jackson Immunoresearch). Binding was evaluated by flow cytometry with a BD FACS Canto, and analyzed using FlowJo™ software. As shown in FIG. 22, the calculated FACS Kd on MDSCs for S9-hIgG1 NSLF was in the low nM range (FIG. 22A), and was ~75 fold weaker with S9.A-hIgG1 LALAPS (FIG. 22B). The calculated FACS Kd for S9.A-hIgG1 LALAPS was more similar to the FACS Kd previously calculated for S9.A-hIgG1 (SEQ ID NO: 40) on the reference cancer cell line, A549, which does not express Fcγ receptors (FIG. 22C). These studies show that Siglec-9-Fc binds with higher affinity to human primary myeloid cells when Fc-Fcγ receptor binding is intact and provide additional evidence for a cooperative binding mechanism.

Example 29: Siglec-9-Fc Shows Broad Binding of Sialic Acid Moieties

Figure 23:
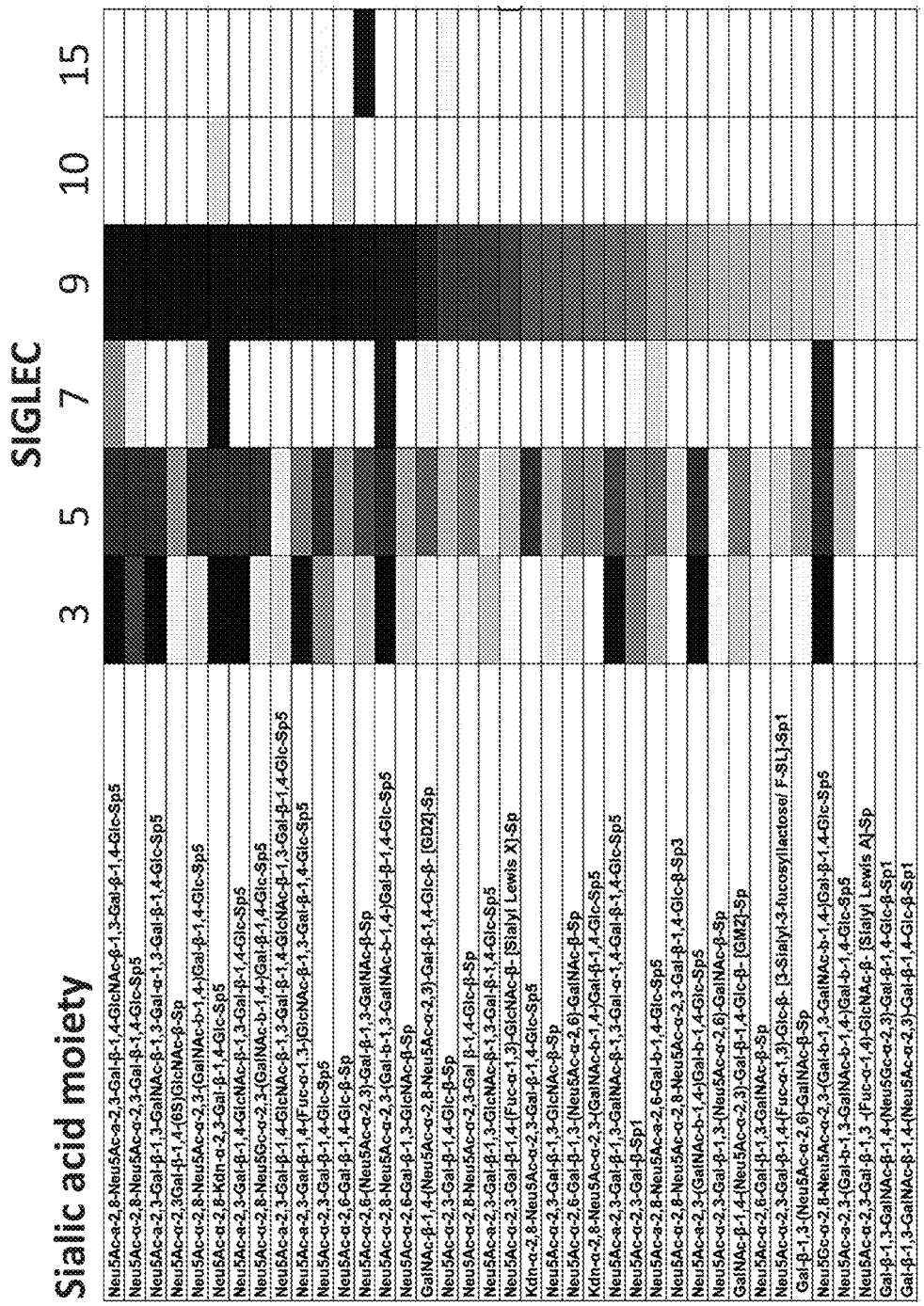
FIG. 23 shows results of exposing a panel of sialic acid containing glycans to various Siglec Fc fusion molecules, including Siglec-9-hIgG1. Darker shading indicates a greater degree of binding. As the figure shows, the Siglec-9-hIgG1 molecule binds to a variety of sialic acid moieties, in contrast to other Siglec fusion molecules.

To assess the binding of several Siglecs to distinct sialic acid glycans, a glycan array composed of 300 different glycan moieties, including sialic acid containing and sialic acid absent glycans, was stained with Siglec-3-Fc, Siglec-5-Fc, Siglec-7-Fc, Siglec-10-Fc and Siglec-15-Fc from R&D systems; Siglec-9-hIgG1 (SEQ ID NO:40, with signal sequence cleaved during production); or an isotype control. Binding was assessed using a fluorescently labeled anti-human antibody. Data were normalized, and normalized fluorescence values were calculated. Staining to a subset of sialic acid containing glycans is shown in FIG. 23. Siglec-9-hIgG1 displayed robust binding to many, but not all types of sialic acid moieties. Binding of Siglec-3-Fc, Siglec-5-Fc, Siglec-7-Fc, Siglec-10-Fc and Siglec-15-Fc were generally more restricted. Siglec-9-hIgG1 bound to all Siglec 10 and 15 ligands, the majority of Siglec 3 and 7 ligands, and about half of Siglec 5 ligands. These results show that Siglec-9-hIgG1 is an efficient blocker of multiple different Siglec ligands compared to other Siglec-Fc constructs, and therefore may have advantages in a therapeutic setting.

Figure 24A:
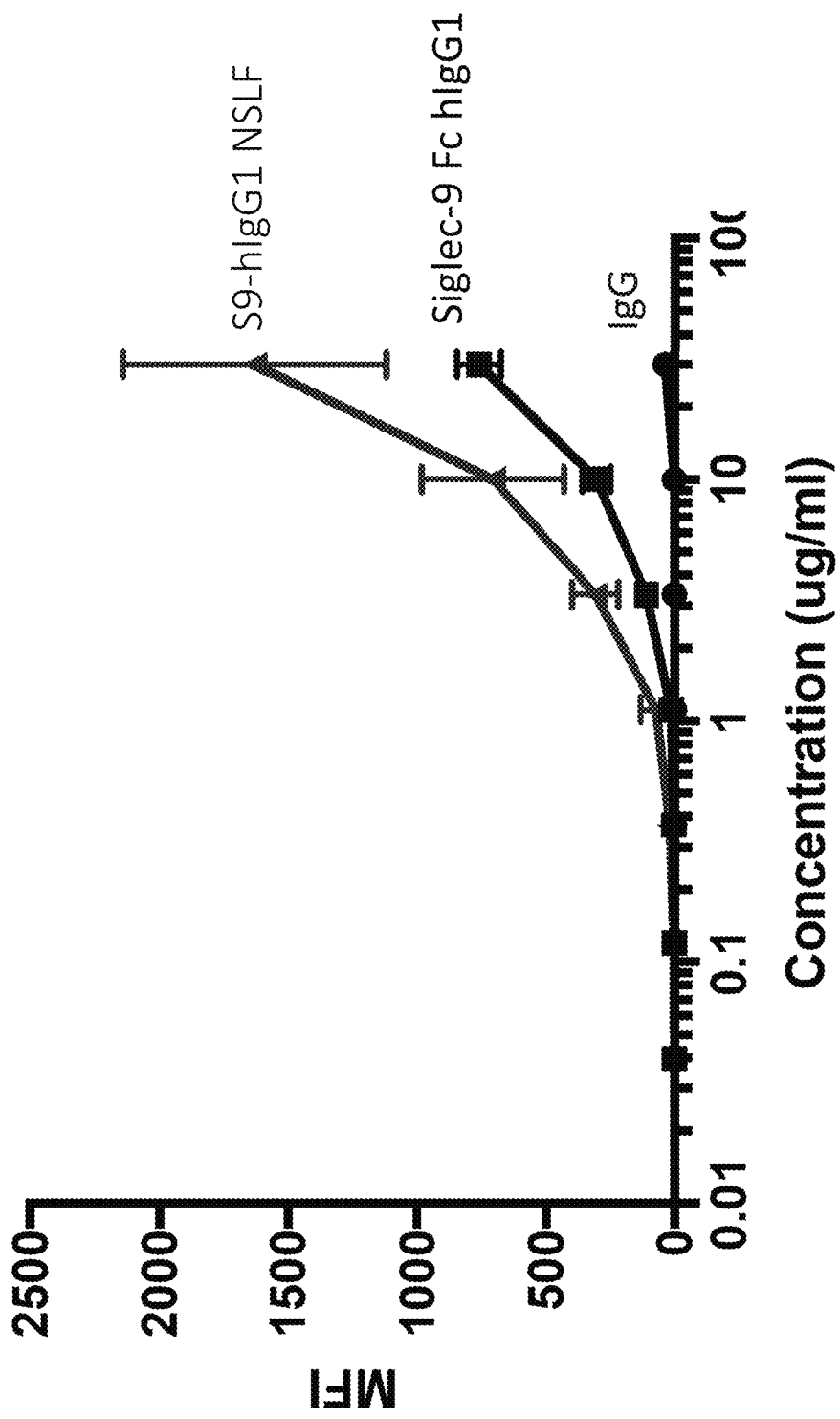
FIG. 24A and FIG. 24B compare the binding of Siglec-9-hIgG1 and Siglec-9-hIgG1 NSLF to blood cells.
Figure 24B:
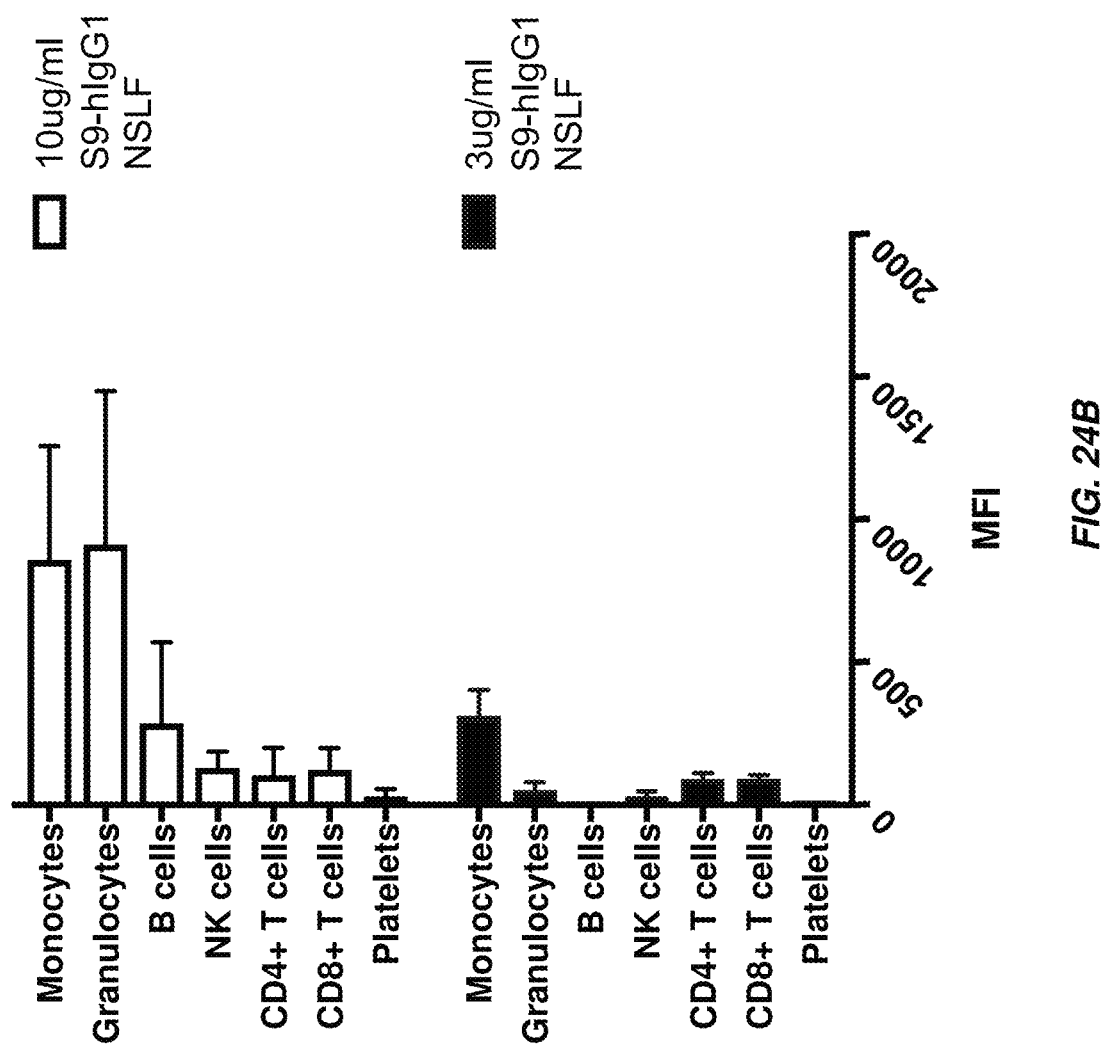

Example 30: Siglec-9-hIgG1 NSLF Shows Enhanced Binding to Innate Immune Cells Compared to Siglec-9-hIgG1 in Human Blood To further demonstrate that cooperative binding of Siglec-9-Fc can occur in whole blood, binding of Siglec-9-Fc was evaluated in the blood of healthy human donors. 100 μl of whole blood was incubated with serial dilutions of Alexa 647-conjugated S9-hIgG1 (SEQ NO. 48, with signal sequence cleaved during production) or S9-hIgG1 NSLF (SEQ NO. 45, with signal sequence cleaved during production). Red Blood cells (RBCs) were lysed and all samples acquired on BD Fortessa™. Mean fluorescence intensity (MFI) and % binding relative to IgG was calculated. S9-hIgG1 NSLF showed enhanced binding to blood monocytes compared to S9-hIgG1 (FIG. 24A). This is consistent with the desired increase in affinity of S9-hIgG1 NSLF to FcγRIIa compared to wild type hIgG1. The highest binding of S9-hIgG1 NSLF was observed on monocytes, with a lower degree of binding observed on granulocytes, NK cells and B cells, and minimal binding to T cells and platelets (FIG. 24B). These data demonstrate that Siglec-9-Fc binds to immune cells in the presence of serum immunoglobulins, in particular to monocytes, granulocytes, and NK cells.

Example 31: Siglec-9-hIgG1 NSLF Restores T Cell Proliferation

Figure 25A:
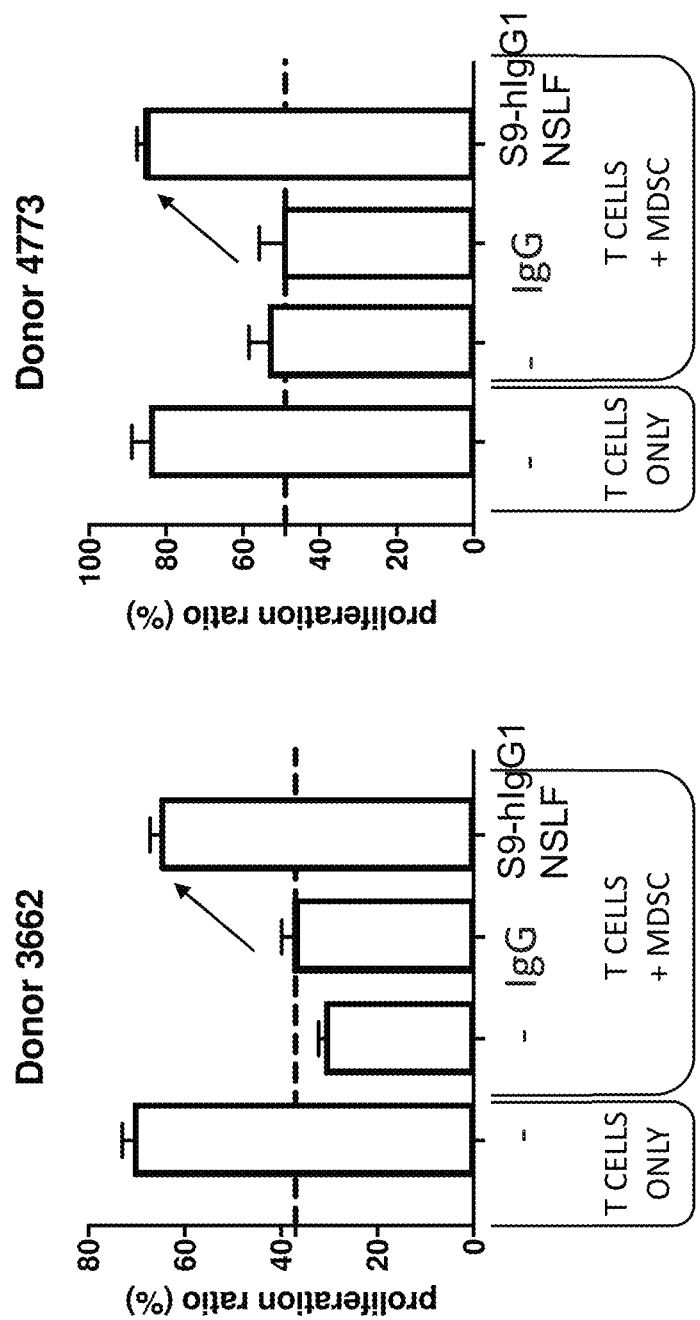
FIG. 25A and FIG. 25B show the effect of Siglec-9-hIgG1 NSLF on T cell proliferation.
Figure 25B:
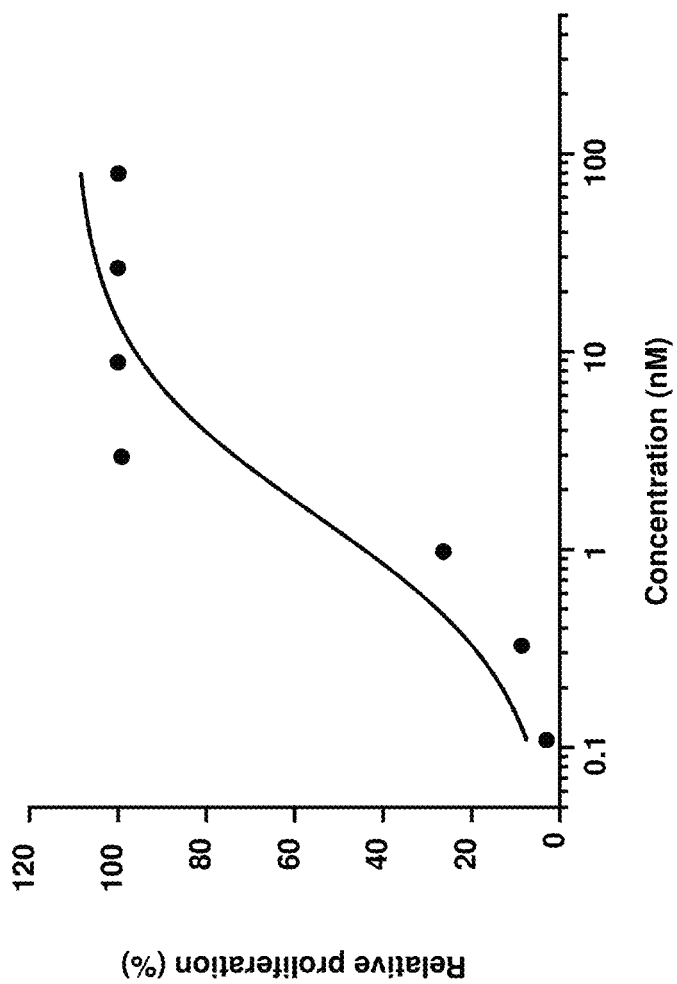

The effect of Siglec-9-hIgG1 NSLF (SEQ ID NO:45, with signal sequence cleaved during production) was determined using methodology similar to that described in Example 10 and FIG. 5. MDSCs were generated from human monocytes by culturing with GM-CSF and IL-6 for 5-6 days. MDSCs were harvested and co-cultured with autologous CD8⁺ T cells in the presence of anti-CD3 and anti-CD28 antibodies and either Siglec-9-hIgG1 NSLF or control IgG. T-cell proliferation was assessed after 3-5 days. As shown in FIG. 25A, the presence of MDSCs inhibited T-cell proliferation, which was restored by Siglec-9-hIgG1 NSLF. The potency of Siglec-9-hIgG1 NSLF was assessed in a dose response, as shown in FIG. 25B. Single digit nM EC50 (~1-2 nM) in restoring T cell proliferation was observed.

Example 32: Siglec-9-hIgG1 NSLF Shows Increased Potency Compared to Siglec-9-hIgG1

Figure 26:
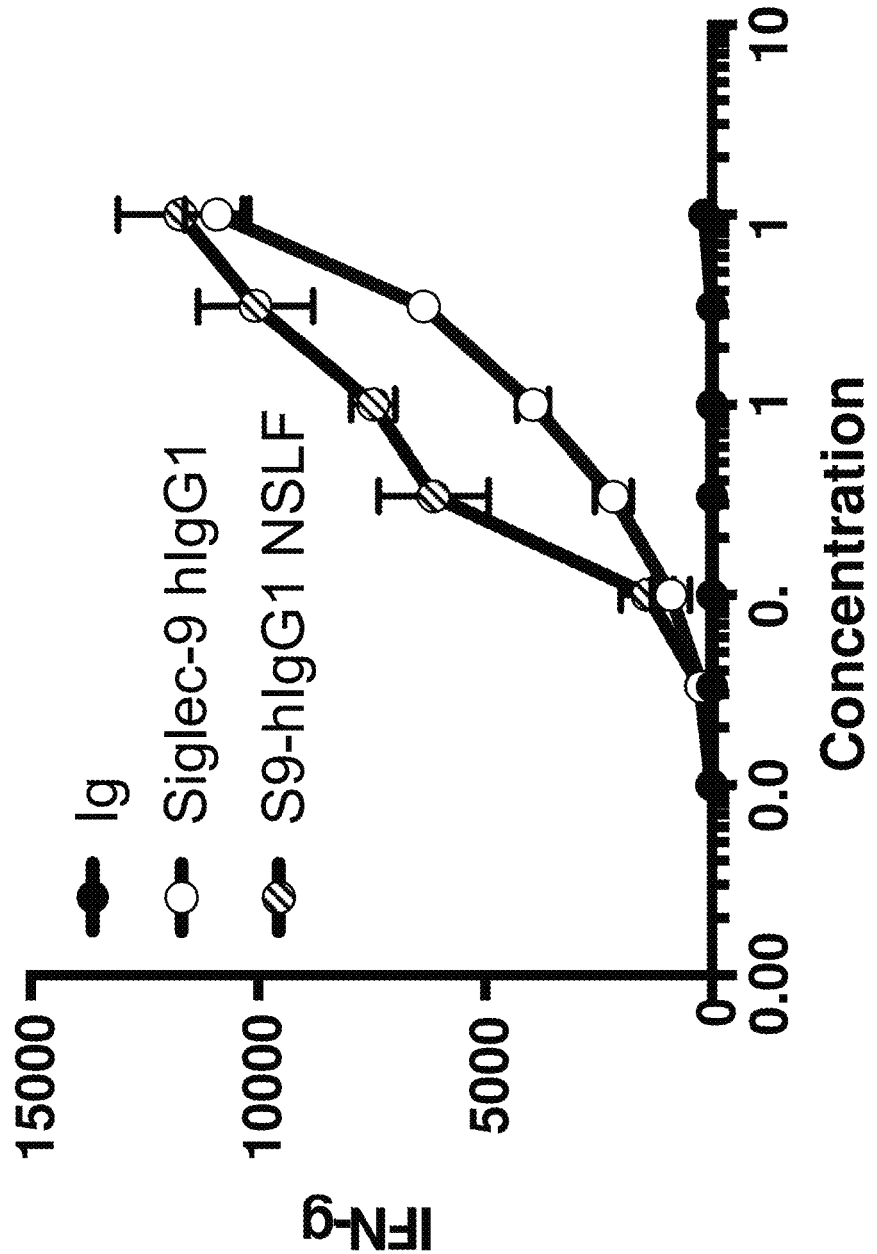
FIG. 26 shows Siglec-9-hIgG1 NSLF demonstrated enhanced potency, by ~10-fold, compared to Siglec-9- hIgG1, in induction of interferon gamma (IFN-g) when Siglec-9-hIgG NSLF was incubated with MDSCs and T cells.

Siglec-9-hIgG1 NSLF (SEQ ID NO:45, with signal sequence cleaved during production) was compared directly with Siglec-9-hIgG1 (SEQ NO. 48, with signal sequence cleaved during production) in the MDSC T cell assay described in Example 10. As shown in FIG. 26, Siglec-9-hIgG1 NSLF demonstrated enhanced potency, by ~10-fold, compared to Siglec-9-hIgG1. Taken together, these data demonstrate a potent effect for Siglec-9-hIgG1 NSLF in relieving myeloid suppression of T cells.

Example 33: Siglec-9-hIgG1 NSLF Induces Cytokine Expression Consistent with Repolarization The induction of different cytokines, chemokines, and costimulatory molecules by Siglec-9-hIgG1 NSLF (SEQ NO. 45, with signal sequence cleaved during production) was analyzed by RNAseq on MDSCs. As shown in FIG. 27, Siglec-9-hIgG1 NSLF induced a robust gene expression profile when incubated with MDSCs, and this profile was consistent with repolarization. Similar profiles were also observed with macrophages and dendritic cells (data not shown).

Example 34: Siglec-9-hIgG1 NSLF Repolarizes Suppressive Myeloid Cells Better than Other Checkpoint Pathways Siglec-9-hIgG1 NSLF (SEQ NO. 45, with signal sequence cleaved during production) was compared directly with antibodies targeting other immune checkpoint pathways for the ability to repolarize suppressive myeloid cells. As shown in FIG. 28, Siglec-9-hIgG1 NSLF is highly effective at repolarizing MDSCs compared to those antibodies. Anti-Siglec-15, anti-LILRB2, and anti-PD-L1 are not able to induce CD86 upregulation or CD206 downregulation at the surface of MDSCs to the extent of Siglec-9-hIgG1 NSLF. These results demonstrate the potential for Siglec-9-hIgG1 NSLF to be a highly effective therapy, potentially more effective than checkpoint inhibitors.

Example 35: Siglec-9-Fc Combines with Anti-PD-L1 to Reduce E0771 Tumor Growth

Using methodology as described in Example 27, the effect of Siglec-9-Fc in combination with anti-PD-L1 was determined. S3/7/9 BAC mice were implanted subcutaneously with E0771 cells. Once tumors reached an average of 100 mm³, the mice were treated i.p. with 20 mg/kg S9.B-mIgG2a and 10 mg/kg anti-PD-L1 antibody 2 times per week for 3 weeks. As shown in FIG. 29, the combination of Siglec-9-Fc with anti-PD-L1 antibody decreased E0771 tumor growth to a greater extent than either Siglec-9-Fc or anti-PD-L1 antibody treatment alone. At day 25 after implantation, 58% tumor growth inhibition was achieved compared to Siglec-9-Fc monotherapy. Mean±SEM is shown. These studies show that the combination of Siglec-9-Fc with a PD-1 or PD-L1 inhibitor, such as an anti-PD-1 or anti-PD-L1 antibody, may improve anti-tumor response.

Example 36: Potential Pharmacodynamic Markers of Siglec-9-Fc

To elucidate the mechanism of action and identify potential pharmacodynamic (PD) markers of response, an immune monitoring study was performed. Mice were inoculated with E0771 tumor cells, randomized into 2 groups at an average volume of 100 mm³ and dosed 3 times with S9.B-mIgG2a (SEQ ID NO. 44, with signal sequence cleaved during production) or isotype control every 3-4 days. Twenty-four hours after the last dose, mice were euthanized, and spleen and tumor harvested for flow cytometry analysis. CD11b is a pleiotropic regulator of myeloid cell function, including regulating adhesion, migration, phagocytosis, and cellular activation. S9.B-mIgG2 induced a significant increase of CD11b and CD86 expression on splenic myeloid cells (FIG. 30). These changes in splenic myeloid cells are consistent with those observed in human MDSCs and represent potential pharmacodynamic markers of Siglec-9-Fc.

Example 37: Further Siglec-9 Variants within and Outside of the IgV Domain

Further Siglec-9-Fc variants were made that would potentially improve properties such as stability and/or PK. Certain variants that were made are shown in FIG. 31, and all contemplated variants are included in the Sequence Table below. In the variants designated S9.32-S9.38, a single tryptophan (W38) in an undesired hydrophobic patch in the IgV domain was substituted with a less hydrophobic residue. The variants designated 59.39 and 59.41-59.45 contain additional substitutions in the IgV domain to potentially further reduce the effect of undesired hydrophobic patches. The variants designated S9.47-S9.53 contain substitutions outside the IgV domain to potentially confer stability. Certain variants were tested for certain properties, as shown in FIG. 31. Additionally, certain variants were tested in assays similar to those described in Example 13 to examine the effects on markers of repolarization in MDSCs. As shown in FIG. 32, variants 59.36, 59.37 and 59.38 behaved comparably to Siglec-9-Fc-hIgG1, showing decreased CD163 (FIG. 32A) and decreased CD206 (FIG. 32B) and increased CD86 (FIG. 32C).

Example 38: Fc Variants to Improve FcRn Binding and Half-Life

Further substitutions and variations were made in the Fc region of Siglec-9-hIgG1 NSLF (SEQ ID NO:45) to potentially improve its half life. It is predicted that the Fc region of Siglec-9-hIgG1 NSLF is bound by the neonatal Fc receptor (FcRn) in the acidic environment of the endosome when Siglec-9-hIgG1 NSLF is taken up by cells in vivo. As a result of this binding, Siglec-9-hIgG1 NSLF would be directed back to the cell surface and released into the extracellular environment under physiologic pH conditions, instead of being degraded within the acidic endosome. By "recycling" Siglec-9-hIgG1 NSLF back into the extracellular environment following internalization, this process may increase the amount of Siglec-9-hIgG1 NSLF in the circulation, thereby resulting in improved half-life. This in turn may enable lower dosages or less frequent dosing.

Accordingly, substitutions and variations were made in the Fc region of Siglec-9-hIgG1 NSLF (SEQ ID NO:45) to improve its binding to FcRn in vitro, and therefore potentially improve its ability to be recycled in vivo. Those substitutions and variations include the "YTE" and "LS" substitutions, and cysteine-containing loop insertions, as described in Dall'Acqua et al. (2002) *J. Immunol.* 169:5171-5180; Zalevsky et al. (2010) *Nat. Biotechnol.* 28:157-159; and U.S. Pat. No. 9,688,756, which are each incorporated herein by reference in their entirety. The sequences of the resulting modified constructs are shown in SEQ ID Nos: 228-230 (the substitutions and variations are indicated by double-underlined residues in the sequence table below). The modified constructs are tested for improved binding to FcRn in vitro, e.g., via surface plasmon resonance, and then examined for improved PK and PD in vivo. Modified constructs are also contemplated which contain the "YTE" or "LS" substitution or cysteine-containing loop insertion, but not the NSLF substitution, in the Fc. Those constructs are shown in SEQ ID Nos: 231-233.

Example 39: Siglec-9-hIgG1 NSLF has Improved Serum PK Compared to Siglec-9-hIgG1

The pharmacokinetic properties of Siglec-9-hIgG1 NSLF (SEQ ID NO:45, with signal sequence cleaved during production) and Siglec-9-hIgG1 (SEQ ID NO:48, with signal sequence cleaved during production) were compared. Cynomolgus monkeys were treated with a single dose of 80 mg/kg IV injections of Siglec-9-hIgG1 or Siglec-9-hIgG1 NSLF. Mean concentration-time profiles for Siglec-9-hIgG1 and Siglec-9-hIgG1 NSLF in the serum of cynomolgus monkeys were determined. FIG. 33 shows that Siglec-9-hIgG1 NSLF (squares) has improved PK over Siglec-9-hIgG1 (circles).

Example 40: Pharmacokinetic Properties of Siglec-9-Fc Variants

The pharmacokinetic properties of certain Siglec-9-Fc variants, as described in Example 37, were determined. S9.1, 59.36, 59.37, 59.38, and 59.45 were given as a single administration via IV bolus injection to Siglec 3/7/9 BAC transgenic mice. As shown in FIG. 34, 59.37 displayed increased $C_{max}$ and $AUC_{0-inf}$. Although the mean $T_{1/2}$ is similar to the other variants, the increase in the AUC in particular may indicate improved exposure (bioavailability) of 59.37 compared to other variants.

Table of Certain Sequences

In the table below, bold and underlined residues in certain SEQ ID Nos show variant Siglec-9 ECD sequences represent residues that differ from the native Siglec-9 ECD sequence. Double-underlined residues in SEQ ID Nos: 228-233 show variant Fc domain residues. In some cases, residue numbers used in the name for a particular Siglec-9 variant in the "Description" column (e.g. S35X) may not match the numbering of the residues in the SEQ ID Nos of the "Sequence" column, (for example, due to the absence or presence of a signal sequence), as can be seen when comparing the bold and underlined mutated residue to its position within the SEQ ID NO below.

| SEQ ID NO | Description | Sequence |
|---|---|---|
| 1 | Human Siglec-9 (with signal sequence) | MLLLLLPLLW GRERAEGQTS KLLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSLQSK ATSGVTQGVV GGAGATALVF |

| SEQ ID NO | Description | Sequence |
|---|---|---|
| | | LSFCVIFVVV RSCRKKSARP AAGVGDTGIE DANAVRGSAS<br>QGPLTEPWAE DSPPDQPPPA SARSSVGEGE LQYASLSFQM<br>VKPWDSRGQE ATDTEYSEIK IHR |
| 2 | Mature human Siglec-9 | SKLLTMQSSV TVQEGLCVHV PCSFSYPSHG WIYPGPVVHG<br>YWFREGANTD QDAPVATNNP ARAVWEETRD RFHLLGDPHT<br>KNCTLSIRDA RRSDAGRYFF RMEKGSIKWN YKHHRLSVNV<br>TALTHRPNIL IPGTLESGCP QNLTCSVPWA CEQGTPPMIS<br>WIGTSVSPLD PSTTRSSVLT LIPQPQDHGT SLTCQVTFPG<br>ASVTTNKTVH LNVSYPPQNL TMTVFQGDGT VSTVLGNGSS<br>LSLPEGQSLR LVCAVDAVDS NPPARLSLSW RGLTLCPSQP<br>SNPGVLELPW VHLRDAAEFT CRAQNPLGSQ QVYLNVSLQS<br>KATSGVTQGV VGGAGATALV FLSFCVIFVV VRSCRKKSAR<br>PAAGVGDIGI EDANAVRGSA SQGPLTEPWA EDSPPDQPPP<br>ASARSSVGEG ELQYASLSFQ MVKPWDSRGQ EATDTEYSEI<br>KIHR |
| 3 | linker | ALTHR |
| 4 | linker | LNVSYP |
| 5 | ITIM motif | LQYASL |
| 6 | SLAM-like motif | TEYSEI |
| 7 | Human Siglec-9 IgV domain | SKLLTMQSSV TVQEGLCVHV PCSFSYPSHG WIYPGPVVHG<br>YWFREGANTD QDAPVATNNP ARAVWEETRD RFHLLGDPHT<br>KNCTLSIRDA RRSDAGRYFF RMEKGSIKWN YKHHRLSVNV T |
| 8 | Siglec-7 loop | VDSQTDSD |
| 9 | Siglec-9 loop | SHGWIYPG |
| 10 | Siglec-9-Fc parental (WIYP); S9.1-hIgG1 (without signal sequence) | S KLLTMQSSVT VQEGLCVHVP CSFSYPSHGW IYPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 11 | Siglec-9-Fc DIEG; S9.2-hIgG1 | S KLLTMQSSVT VQEGLCVHVP CSFSYPSHGD IEGGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 12 | Siglec-9-Fc SIET; S9.3-hIgG1 | S KLLTMQSSVT VQEGLCVHVP CSFSYPSHGS IETGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST |

| SEQ ID NO | Description | Sequence |
|---|---|---|
| | | YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 13 | Siglec-9-Fc SIEP; S9.4-hIgG1 | S KLLTMQSSVT VQEGLCVHVP CSFSYPSHGS IEPGPVVHGY<br>WFREGANTDQ DAPVATNNPA RAVWEETRDR F̲HLL̲GDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 14 | Siglec-9-Fc DIEP; S9.5-hIgG1 | S KLLTMQSSVT VQEGLCVHVP CSFSYPSHGD IEPGPVVHGY<br>WFREGANTDQ DAPVATNNPA RAVWEETRDR F̲HLL̲GDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKENWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 15 | Siglec-9-Fc YQES; S9.6-hIgG1 | S KLLTMQSSVT VQEGLCVHVP CSFSYPSHGY QESGPVVHGY<br>WFREGANTDQ DAPVATNNPA RAVWEETRDR F̲HLL̲GDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKENWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 16 | Siglec-9-Fc THET; S9.7-hIgG1 | S KLLTMQSSVT VQEGLCVHVP CSFSYPSHGT HETGPVVHGY<br>WFREGANTDQ DAPVATNNPA RAVWEETRDR F̲HLL̲GDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD KPREEQYNST<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 17 | Siglec-9-Fc L23T H26S H80Y L82E; S9.8-hIgG1 | S KLLTMQSSVT VQEGTCVSVP CSFSYPSHGW IYPGPVVHGY<br>WFREGANTDQ DAPVATN̲N̲PA RAVWEETRDR FYLEGDPHTK<br>NCTLSIRDAR RSDAGRYFFR MEKGSIKWNY KH̲H̲RLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA |

| SEQ ID NO | Description | Sequence |
|---|---|---|
| | | KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 18 | Siglec-9-Fc L23T H26T H80Y L82D; S9.9-hIgG1 | S KLLTMQSSVT VQEGTCVTVP CSFSYPSHGW IYPGPVVHGY WFREGANTDQ DAPVATNNPA RAVWEETRDR FYLDGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 19 | Siglec-9-Fc S35D W38T; S9.10-hIgG1 | S KLLTMQSSVT VQEGLCVHVP CSFSYPDHGT IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 20 | Siglec-9-Fc S35D W38E; S9.11-hIgG1 | S KLLTMQSSVT VQEGLCVHVP CSFSYPDHGE IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 21 | Siglec-9-Fc W38S I39H Y40H; S9.12-hIgG1 | S KLLTMQSSVT VQEGLCVHVP CSFSYPSHGS HHPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 22 | Siglec-9-Fc S35D W38Q I39H Y40E; S9.13-hIgG1 | S KLLTMQSSVT VQEGLCVHVP CSFSYPDHGQ HEPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA |

| SEQ ID NO | Description | Sequence |
|---|---|---|
| | | KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 23 | Siglec-9-Fc S35T W38Q I39H Y40E; S9.14-hIgG1 | S KLLTMQSSVT VQEGLCVHVP CSFSYPTHGS HEPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 24 | Siglec-9-Fc S35D W38E I39T; S9.15-hIgG1 | S KLLTMQSSVT VQEGLCVHVP CSFSYPDHGE TYPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 25 | Siglec-9-Fc S35N W38E I39T; S9.16-hIgG1 | S KLLTMQSSVT VQEGLCVHVP CSFSYPNHGT EYPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 26 | Siglec-9-Fc S35H W38T I39T Y40T; S9.17-hIgG1 | S KLLTMQSSVT VQEGLCVHVP CSFSYPHHGT TTPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS DGVEVHNAKT KPREEQYNST<br>TCVVVDVSHE DPEVKFNWYV VFLFPPKPKD TLMISRTPEV<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 27 | Siglec-9-Fc S35H W38S I39T Y40T; S9.18-hIgG1 | S KLLTMQSSVT VQEGLCVHVP CSFSYPHHGS TTPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV |

| SEQ ID NO | Description | Sequence |
|---|---|---|
| 28 | Siglec-9-Fc W38G I39T Y40E; S9.19-hIgG1 | S KLLTMQSSVT VQEGLCVHVP CSFSYPSHGG TEPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 29 | Siglec-9-Fc S8D K9Y L10T W116E; S9.20-hIgG1 | D YTLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKENY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 30 | Siglec-9-Fc S8D K9Y L10Q W116N; S9.21-hIgG1 | D YQLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKNNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 31 | Siglec-9-Fc S8E K9Y L10T W116E; S9.22-hIgG1 | E YTLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKENY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 32 | Siglec-9-Fc WIYP to QTDS; S9.23-hIgG1 | S KLLTMQSSVT VQEGLCVHVP CSFSYPSHGQ TDSGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA |

| SEQ ID NO | Description | Sequence |
|---|---|---|
| | | KGQPREPQVY TLPPSRDELT KNQVSLTCLV KGFYPSDIAV |
| | | EWESNGQPEN NYKTTPPVLD SDGSFFLYSK LTVDKSRWQQ |
| | | GNVFSCSVMH EALHNHYTQK SLSLSPGK |
| 33 | Siglec-9-Fc GWIYP to SQTDS; S9.24-hIgG1 | S KLLTMQSSVT VQEGLCVHVP CSFSYPSHSQ TDSGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 34 | Siglec-9-Fc SHGWIYPG to VDSQTDSD; S9.25-hIgG1 | S KLLTMQSSVT VQEGLCVHVP CSFSYPVDSQ TDSDPVVHG YWFREGANTD QDAPVATNNP ARAVWEETRD RFHLLGDPHT KNCTLSIRDA RRSDAGRYFF RMEKGSIKWN YKHHRLSVNV TALTHRPNIL IPGTLESGCP QNLTCSVPWA CEQGTPPMIS WIGTSVSPLD PSTTRSSVLT LIPQPQDHGT SLTCQVTFPG ASVTTNKTVH LNVSYPPQNL TMTVFQGDGT VSTVLGNGSS LSLPEGQSLR LVCAVDAVDS NPPARLSLSW RGLTLCPSQP SNPGVLELPW VHLRDAAEFT CRAQNPLGSQ QVYLNVSEPK SCDKTHTCPP CPAPELLGGP SVFLFPPKPK DTLMISRTPE VTCVVVDVSH EDPEVKFNWY VDGVEVHNAK TKPREEQYNS TYRVVSVLTV LHQDWLNGKE YKCKVSNKAL PAPIEKTISK AKGQPREPQV YTLPPSRDEL TKNQVSLTCL VKGFYPSDIA VEWESNGQPE NNYKTTPPVL DSDGSFFLYS KLTVDKSRWQ QGNVFSCSVM HEALHNHYTQ KSLSLSPGK |
| 35 | Siglec-9-Fc SHGWIYPG to VHGQIDSD; S9.26-hIgG1 | S KLLTMQSSVT VQEGLCVHVP CSFSYPVHGQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS TCVVVDVSHE DPEVKFNWYV DGVEVHNAKT KPREEQYNST CDKTHTCPPC PAPELLGGPS VFLFPPKPKD TLMISRTPEV YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 36 | Siglec-9-Fc SHGWIYPG to VHSQIDSD; S9.27-hIgG1 | S KLLTMQSSVT VQEGLCVHVP CSFSYPVHSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKENWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 37 | Siglec-9-Fc SHGWIYPG to VDSQIDSD; S9.28-hIgG1 | S KLLTMQSSVT VQEGLCVHVP CSFSYPVDSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV |

| SEQ ID NO | Description | Sequence |
|---|---|---|
| | | EWESNGQPEN NYKTTPPVLD SDGSFFLYSK LTVDKSRWQQ<br>GNVFSCSVMH EALHNHYTQK SLSLSPGK |
| 38 | Siglec-9-Fc SHGWIYPG to SDSQIDSD; S9.29-hIgG1 | S KLLTMQSSVT VQEGLCVHVP CSFSYPSDSQ IDSDPVVHGY<br>WFREGANTDQ DAPVATNNPA RAVWEETRDR FHLLGDPHTK<br>NLTCSVPWAC EQGTPPMISW MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 39 | Siglec-9-Fc SHGWIYPG to VDGQIDSD; S9.30-hIgG1 | S KLLTMQSSVT VQEGLCVHVP CSFSYPVDGQ IDSDPVVHGY<br>WFREGANTDQ DAPVATNNPA RAVWEETRDR FHLLGDPHTK<br>NLTCSVPWAC EQGTPPMISW MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVSEPKS<br>CDKTHTCPPC PAPELLGGPS VFLFPPKPKD TLMISRTPEV<br>TCVVVDVSHE DPEVKFNWYV DGVEVHNAKT KPREEQYNST<br>YRVVSVLTVL HQDWLNGKEY KCKVSNKALP APIEKTISKA<br>KGQPREPQVY TLPPSRDELT KNQVSLTCLV KGFYPSDIAV<br>EWESNGQPEN NYKTTPPVLD SDGSFFLYSK LTVDKSRWQQ<br>GNVFSCSVMH EALHNHYTQK SLSLSPGK |
| 40 | S9.A-hIgG1 (signal sequence is amino acids 1-19; mature sequence is amino acids 20-586) | MLLLLLPLLW GRERAEGQTS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLTLCPSQPS NPGVLELPWV HLRDAAEFTC<br>RAQNPLGSQQ VYLNVSLQSK ATSGVTQGDI EGRMDCKPCI<br>KTHTCPPCPA PEAAGGPSVF LFPPKPKDTL MISRTPEVTC<br>VVVDVSHEDP EVKFNWYVDG VEVHNAKTKP REEQYNSTYR<br>VVSVLTVLHQ DWLNGKEYKC KVSNKALPAS IEKTISKAKG<br>QPREPQVYTL PPSRDELTKN QVSLTCLVKG FYPSDIAVEW<br>ESNGQPENNY KTTPPVLDSD GSFFLYSKLT VDKSRWQQGN<br>VFSCSVMHEA LHNHYTQKSL SLSPGK |
| 41 | S9.A-hIgG1 NSLF (signal sequence is amino acids 1-19; mature sequence is amino acids 20-586) | MLLLLLPLLW GRERAEGQTS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLTLCPSQPS NPGVLELPWV HLRDAAEFTC<br>RAQNPLGSQQ VYLNVSLQSK ATSGVTQGDI EGRMDCKPCI<br>KTHTCPPCPA PEAAGGPSVF LFPPKPKDTL MISRTPEVTC<br>VVVDVSHEDP EVKFNWYVDG VEVHNAKTKP REEQYNSTYR<br>VVSVLTVLHQ DWLNGKEYKC KVSNKALPAS IEKTISKAKG<br>QPREPQVYTL PPSRDELTKN QVSLTCLVKG FYPSDIAVEW<br>ESNGQPENNY KTTPPVLDSD GSFFLYSKLT VDKSRWQQGN<br>VFSCSVMHEA LHNHYTQKSL SLSPGK |
| 42 | S9.A-hIgG1 LALAPS (signal sequence is amino acids 1-19; mature sequence is amino acids 20-586) | MLLLLLPLLW GRERAEGQTS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLTLCPSQPS NPGVLELPWV HLRDAAEFTC<br>RAQNPLGSQQ VYLNVSLQSK ATSGVTQGDI EGRMDPKSCD<br>KTHTCPPCPA PEAAGGPSVF LFPPKPKDTL MISRTPEVTC<br>VVVDVSHEDP EVKFNWYVDG VEVHNAKTKP REEQYNSTYR |

| SEQ ID NO | Description | Sequence |
|---|---|---|
| | | VVSVLTVLHQ DWLNGKEYKC KVSNKALPAS IEKTISKAKG<br>QPREPQVYTL PPSRDELTKN QVSLTCLVKG FYPSDIAVEW<br>ESNGQPENNY KTTPPVLDSD GSFFLYSKLT VDKSRWQQGN<br>VFSCSVMHEA LHNHYTQKSL SLSPGK |
| 43 | S9.A-mIgG1 (signal sequence is amino acids 1-19; mature sequence is amino acids 20-576) | MLLLLLPLLW GRERAEGQTS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSRL VCAVDAVDSN<br>PPARLSLSWR GLTLCPSQPS NPGVLELPWV HLRDAAEFTC<br>RAQNPLGSQQ VYLNVSLQSK ATSGVTQGDI EGRMDCKPCI<br>CTVPEVSSVF IFPPKPKDVL TITLTPKVTC VVVDISKDDP<br>EVQFSWFVDD VEVHTAQTQP REEQFNSTFR SVSELPIMHQ<br>DWLNGKEFKC RVNSAAFPAP IEKTISKTKG RPKAPQVYTI<br>PPPKEQMAKD KVSLTCMITD FFPEDITVEW QWNGQPAENY<br>KNTQPIMNTN GSYFVYSKLN VQKSNWEAGN TFTCSVLHEG<br>LHNHHTEKSL SHSPGK |
| 44 | S9.B-mIgG2a (signal sequence is amino acids 1-19; mature sequence is amino acids 20-587) | MGWSCIILFL VATATGVHSS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSRL VCAVDAVDSN<br>PPARLSLSWR GLTLCPSQPS NPGVLELPWV HLRDAAEFTC<br>RAQNPLGSQQ VYLNVSLQSK ATSGVTQGGG GGSIEPRGPT<br>IKPCPPCKCP APNLLGGPSV FIFPPKIKDV LMISLSPIVT<br>CVVVDVSEDD PDVQISWFVN NVEVHTAQTQ THREDYNSTL<br>RVVSALPIQH QDWMSGKEFK CKVNNKDLPA PIERTISKPK<br>GSVRAPQVYV LPPPEEEMTK KQVTLTCMVT DFMPEDIYVE<br>WTNNGKTELN YKNTEPVLDS DGSYFMYSKL RVEKKNWVER<br>NSYSCSVVHE GLHNHHTTKS FSRTPGK |
| 45 | S9.1-hIgG1 NSLF | MGWSCIILFL VATATGVHSS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSRL VCAVDAVDSN<br>PPARLSLSWR GLTLCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSSKAFP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 46 | S9.1-hIgG4 S228P | MGWSCIILFL VATATGVHSS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSRL VCAVDAVDSN<br>PPARLSLSWR GLTLCPSQPS NPGVLELPWV HLRDAAEFTC<br>RAQNPLGSQQ VYLNVSLQSK ATSGVTQGES KYGPPCPPCP<br>APEFLGGPSV FLFPPKPKDT LMISRTPEVT CVVVDVSQED<br>QDWLNGKEYK CKVSNKGLPS SIEKTISKAK GQPREPQVYT<br>PEVQFNWYVD GVEVHNAKTK PREEQFNSTY RVVSVLTVLH<br>LPPSQEEMTK NQVSLTCLVK GFYPSDIAVE WESNGQPENN<br>YKTTPPVLDS DGSFFLYSRL TVDKSRWQEG NVFSCSVMHE<br>ALHNHYTQKS LSLSLGK |
| 47 | S9.1-hIgG1 K322A | MGWSCIILFL VATATGVHSS KLLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSRL VCAVDAVDSN |

| SEQ ID NO | Description | Sequence |
|---|---|---|
| | | PPARLSLSWR GLTLCPSQPS NPGVLELPWV HLRDAAEFTC
RAQNPLGSQQ VYLNVSEPKS CDKTHTCPPC PAPELLGGPS
VFLFPPKPKD TLMISRTPEV TCVVVDVSHE DPEVKFNWYV
DGVEVHNAKT KPREEQYNST YRVVSVLTVL HQDWLNGKEY
KCAVSNKALP APIEKTISKA KGQPREPQVY TLPPSRDELT
KNQVSLTCLV KGFYPSDIAV EWESNGQPEN NYKTTPPVLD
SDGSFFLYSK LTVDKSRWQQ GNVFSCSVMH EALHNHYTQK
SLSLSPGK |
| 48 | Signal sequence (SS)-Siglec-9-Fc parental (WIYP); SS-S9.1-hIgG1 | MGWSCIILFL VATATGVHSS KLLTMQSSVT VQEGLCVHVP
CSFSYPSHGW IYPGPVVHGY WFREGANTDQ DAPVATNNPA
RAVWEETRDR FHLLGDPHTK NCTLSIRDAR RSDAGRYFFR
MEKGSIKWNY KHHRLSVNVT ALTHRPNILI PGTLESGCPQ
NLTCSVPWAC EQGTPPMISW IGTSVSPLDP STTRSSVLTL
IPQPQDHGTS LTCQVTFPGA SVTTNKTVHL NVSYPPQNLT
MTVFQGDGTV STVLGNGSSL SLPEGQSLRL VCAVDAVDSN
PPARLSLSWR GLTLCPSQPS NPGVLELPWV HLRDAAEFTC
RAQNPLGSQQ VYLNVSEPKS CDKTHTCPPC PAPELLGGPS
VFLFPPKPKD TLMISRTPEV TCVVVDVSHE DPEVKFNWYV
DGVEVHNAKT KPREEQYNST YRVVSVLTVL HQDWLNGKEY
KCAVSNKALP APIEKTISKA KGQPREPQVY TLPPSRDELT
KNQVSLTCLV KGFYPSDIAV EWESNGQPEN NYKTTPPVLD
SDGSFFLYSK LTVDKSRWQQ GNVFSCSVMH EALHNHYTQK
SLSLSPGK |
| 49 | SS-Siglec-9-Fc DIEG; SS-S9.2-hIgG1 | MGWSCIILFL VATATGVHSS KLLTMQSSVT VQEGLCVHVP
CSFSYPSHG<u>D</u> <u>IEG</u>GPVVHGY WFREGANTDQ DAPVATNNPA
RAVWEETRD<u>R</u> FHLLGDPHTK NCTLSIRDAR RSDAGRYFFR
MEKGSIKWNY KHHRLSVNVT ALTHRPNILI PGTLESGCPQ
NLTCSVPWAC EQGTPPMISW IGTSVSPLDP STTRSSVLTL
IPQPQDHGTS LTCQVTFPGA SVTTNKTVHL NVSYPPQNLT
MTVFQGDGTV STVLGNGSSL SLPEGQSLRL VCAVDAVDSN
PPARLSLSWR GLTLCPSQPS NPGVLELPWV HLRDAAEFTC
RAQNPLGSQQ VYLNVSEPKS CDKTHTCPPC PAPELLGGPS
VFLFPPKPKD TLMISRTPEV TCVVVDVSHE DPEVKFNWYV
DGVEVHNAKT KPREEQYNST YRVVSVLTVL HQDWLNGKEY
KCAVSNKALP APIEKTISKA KGQPREPQVY TLPPSRDELT
KNQVSLTCLV KGFYPSDIAV EWESNGQPEN NYKTTPPVLD
SDGSFFLYSK LTVDKSRWQQ GNVFSCSVMH EALHNHYTQK
SLSLSPGK |
| 50 | SS-Siglec-9-Fc SIET; SS-S9.3-hIgG1 | MGWSCIILFL VATATGVHSS KLLTMQSSVT VQEGLCVHVP
CSFSYPSHG<u>S</u> <u>IET</u>GPVVHGY WFREGANTDQ DAPVATNNPA
RAVWEETRD<u>R</u> FHLLGDPHTK NCTLSIRDAR RSDAGRYFFR
MEKGSIKWNY KHHRLSVNVT ALTHRPNILI PGTLESGCPQ
NLTCSVPWAC EQGTPPMISW IGTSVSPLDP STTRSSVLTL
IPQPQDHGTS LTCQVTFPGA SVTTNKTVHL NVSYPPQNLT
MTVFQGDGTV STVLGNGSSL SLPEGQSLRL VCAVDAVDSN
PPARLSLSWR GLTLCPSQPS NPGVLELPWV HLRDAAEFTC
RAQNPLGSQQ VYLNVSEPKS CDKTHTCPPC PAPELLGGPS
VFLFPPKPKD TLMISRTPEV TCVVVDVSHE DPEVKFNWYV
DGVEVHNAKT KPREEQYNST YRVVSVLTVL HQDWLNGKEY
KCAVSNKALP APIEKTISKA KGQPREPQVY TLPPSRDELT
KNQVSLTCLV KGFYPSDIAV EWESNGQPEN NYKTTPPVLD
SDGSFFLYSK LTVDKSRWQQ GNVFSCSVMH EALHNHYTQK
SLSLSPGK |
| 51 | SS-Siglec-9-Fc SIEP; SS-S9.4-hIgG1 | MGWSCIILFL VATATGVHSS KLLTMQSSVT VQEGLCVHVP
CSFSYPSHG<u>S</u> <u>IE</u>PGPVVHGY WFREGANTDQ DAPVATNNPA
RAVWEETRD<u>R</u> FHLLGDPHTK NCTLSIRDAR RSDAGRYFFR
MEKGSIKWNY KHHRLSVNVT ALTHRPNILI PGTLESGCPQ
NLTCSVPWAC EQGTPPMISW IGTSVSPLDP STTRSSVLTL
IPQPQDHGTS LTCQVTFPGA SVTTNKTVHL NVSYPPQNLT
MTVFQGDGTV STVLGNGSSL SLPEGQSLRL VCAVDAVDSN
PPARLSLSWR GLTLCPSQPS NPGVLELPWV HLRDAAEFTC
RAQNPLGSQQ VYLNVSEPKS CDKTHTCPPC PAPELLGGPS
VFLFPPKPKD TLMISRTPEV TCVVVDVSHE DPEVKFNWYV
DGVEVHNAKT KPREEQYNST YRVVSVLTVL HQDWLNGKEY
KCAVSNKALP APIEKTISKA KGQPREPQVY TLPPSRDELT
KNQVSLTCLV KGFYPSDIAV EWESNGQPEN NYKTTPPVLD
SDGSFFLYSK LTVDKSRWQQ GNVFSCSVMH EALHNHYTQK
SLSLSPGK |
| 52 | SS-Siglec-9-Fc DIEP; SS-S9.5-hIgG1 | MGWSCIILFL VATATGVHSS KLLTMQSSVT VQEGLCVHVP
CSFSYPSHG<u>D</u> <u>IE</u>PGPVVHGY WFREGANTDQ DAPVATNNPA
RAVWEETRD<u>R</u> FHLLGDPHTK NCTLSIRDAR RSDAGRYFFR |

| SEQ ID NO | Description | Sequence |
|---|---|---|
|  |  | MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCAVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 53 | SS-Siglec-9-Fc YQES; SS-S9.6-hIgG1 | MGWSCIILFL VATATGVHSS KLLTMQSSVT VQEGLCVHVP CSFSYPSHGY QESGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCAVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 54 | SS-Siglec-9-Fc THET; SS-S9.7-hIgG1 | MGWSCIILFL VATATGVHSS KLLTMQSSVT VQEGLCVHVP CSFSYPSHGT HETGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 55 | SS-Siglec-9-Fc L23T H26S H80Y L82E; SS-S9.8-hIgG1 | MGWSCIILFL VATATGVHSS KLLTMQSSVT VQEGTCVSVP CSFSYPSHGW IYPGPVVHGY WFREGANTDQ DAPVATNNPA RAVWEETRDR FYLEGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 56 | SS-Siglec-9-Fc L23T H26T H80Y L82D; SS-S9.9-hIgG1 | MGWSCIILFL VATATGVHSS KLLTMQSSVT VQEGTCVTVP CSFSYPSHGW IYPGPVVHGY WFREGANTDQ DAPVATNNPA RAVWEETRDR FYLDGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |

| SEQ ID NO | Description | Sequence |
|---|---|---|
| 57 | SS-Siglec-9-Fc S35D W38T; SS-S9.10-hIgG1 | MGWSCIILFL VATATGVHSS KLLTMQSSVT VQEGLCVHVP CSFSYPDHGT IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 58 | SS-Siglec-9-Fc S35D W38E; SS-S9.11-hIgG1 | MGWSCIILFL VATATGVHSS KLLTMQSSVT VQEGLCVHVP CSFSYPDHGE IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 59 | SS-Siglec-9-Fc W38S I39H Y40H; SS-S9.12-hIgG1 | MGWSCIILFL VATATGVHSS KLLTMQSSVT VQEGLCVHVP CSFSYPSHGS HHPGPVVHGY WFREGANTDQ DAPVATNNPA RAVWEETRDR FHLLGDPHTK NCTLSIRDAR RSDAGRYFFR MEKGSIKWNY LTCQVTFPGA SVTTNKTVHL NVSYPPQNLT NLTCSVPWAC STVLGNGSSL KGQPREPQVY TLPPSRDELT IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 60 | SS-Siglec-9-Fc S35D W38Q I39H Y40E; SS-S9.13-hIgG1 | MGWSCIILFL VATATGVHSS KLLTMQSSVT VQEGLCVHVP CSFSYPDHGQ HEPGPVVHGY WFREGANTDQ DAPVATNNPA RAVWEETRDR FHLLGDPHTK NCTLSIRDAR RSDAGRYFFR MEKGSIKWNY LTCQVTFPGA SVTTNKTVHL NVSYPPQNLT NLTCSVPWAC STVLGNGSSL KGQPREPQVY TLPPSRDELT IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 61 | SS-Siglec-9-Fc S35T W38Q I39H Y40E; SS-S9.14-hIgG1 | MGWSCIILFL VATATGVHSS KLLTMQSSVT VQEGLCVHVP CSFSYPTHGS HEPGPVVHGY WFREGANTDQ DAPVATNNPA RAVWEETRDR FHLLGDPHTK NCTLSIRDAR RSDAGRYFFR MEKGSIKWNY LTCQVTFPGA SVTTNKTVHL NVSYPPQNLT NLTCSVPWAC STVLGNGSSL KGQPREPQVY TLPPSRDELT IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY |

| SEQ ID NO | Description | Sequence |
|---|---|---|
| | | KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 62 | SS-Siglec-9-Fc S35D W38E I39T; SS-S9.15-hIgG1 | MGWSCIILFL VATATGVHSS KLLTMQSSVT VQEGLCVHVP<br>CSFSYP<u>D</u>HG<u>E</u> <u>T</u>YPGPVVHGY WFREGANTDQ DAPVATNNPA<br>RAVWEE<u>T</u>RDR FHLLGDPHTK NCTLSIRDAR RSDAGRYFFR<br>MEKGSIKWNY LTCQVTFPGA SVTTNKTVHL NVSYPPQNLT<br>NLTCSVPWAC STVLGNGSSL KGQPREPQVY TLPPSRDELT<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLILCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 63 | SS-Siglec-9-Fc S35N W38E I39T; SS-S9.16-hIgG1 | MGWSCIILFL VATATGVHSS KLLTMQSSVT VQEGLCVHVP<br>CSFSYP<u>N</u>HG<u>T</u> <u>E</u>YPGPVVHGY WFREGANTDQ DAPVATNNPA<br>RAVWEE<u>T</u>RDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLILCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 64 | SS-Siglec-9-Fc S35H W38T I39T Y40T; SS-S9.17-hIgG1 | MGWSCIILFL VATATGVHSS KLLTMQSSVT VQEGLCVHVP<br>CSFSYP<u>H</u>HG<u>T</u> <u>TT</u>PGPVVHGY WFREGANTDQ DAPVATNNPA<br>RAVWEE<u>T</u>RDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLILCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 65 | SS-Siglec-9-Fc S35H W38S I39T Y40T; SS-S9.18-hIgG1 | MGWSCIILFL VATATGVHSS KLLTMQSSVT VQEGLCVHVP<br>CSFSYP<u>H</u>HG<u>S</u> <u>TT</u>PGPVVHGY WFREGANTDQ DAPVATNNPA<br>RAVWEE<u>T</u>RDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLILCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 66 | SS-Siglec-9-Fc W38G I39T Y40E; SS-S9.19-hIgG1 | MGWSCIILFL VATATGVHSS KLLTMQSSVT VQEGLCVHVP<br>CSFSYPSHG<u>G</u> <u>TE</u>PGPVVHGY WFREGANTDQ DAPVATNNPA<br>RAVWEE<u>T</u>RDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN |

| SEQ ID NO | Description | Sequence |
|---|---|---|
| | | PPARLSLSWR GLTLCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 67 | SS-Siglec-9-Fc S8D K9Y L10T W116E; SS-S9.20-hIgG1 | MGWSCIILFL VATATGVHSD YTLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKENY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLTLCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKFNWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 68 | SS-Siglec-9-Fc S8D K9Y L10Q W116N; | MGWSCIILFL VATATGVHSD YQLTMQSSVT VQEGLCVHVP<br>CSFSYPSHGW IYPGPVVHGY WFREGANTDQ DAPVATNNPA<br>MEKGSIKNNY KHHRLSVNVT ALTHRPNILI PGTLESGCPQ<br>NLTCSVPWAC EQGTPPMISW IGTSVSPLDP STTRSSVLTL<br>IPQPQDHGTS STVLGNGSSL SLPEGQSLRL VCAVDAVDSN<br>MTVFQGDGTV LTCQVTFPGA SVTTNKTVHL NVSYPPQNLT<br>PPARLSLSWR GLTLCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKENWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 69 | SS-Siglec-9-Fc S8E K9Y L10T W116E; SS-S9.22-hIgG1 | MGWSCIILFL VATATGVHSE YTLTMQSSVT VQEGLCVHVP<br>CSFSYPSHGW IYPGPVVHGY WFREGANTDQ DAPVATNNPA<br>RAVWEETRDR FHLLGDPHTK NCTLSIRDAR RSDAGRYFFR<br>MEKGSIKENY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR TLMISRTPEV NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKENWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 70 | SS-Siglec-9-Fc WIYP to QTDS; SS-S9.23-hIgG1 | MGWSCIILFL VATATGVHSS KLLTMQSSVT VQEGLCVHVP<br>CSFSYPSHGQ TDSGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ<br>NLTCSVPWAC EQGTPPMISW IGTSVSPLDP STTRSSVLTL<br>IPQPQDHGTS LTCQVTFPGA SVTTNKTVHL NVSYPPQNLT<br>MTVFQGDGTV STVLGNGSSL SLPEGQSLRL VCAVDAVDSN<br>PPARLSLSWR GLTLCPSQPS NPGVLELPWV HLRDAAEFTC<br>RAQNPLGSQQ VYLNVSEPKS CDKTHTCPPC PAPELLGGPS<br>VFLFPPKPKD TLMISRTPEV TCVVVDVSHE DPEVKENWYV<br>DGVEVHNAKT KPREEQYNST YRVVSVLTVL HQDWLNGKEY<br>KCKVSNKALP APIEKTISKA KGQPREPQVY TLPPSRDELT<br>KNQVSLTCLV KGFYPSDIAV EWESNGQPEN NYKTTPPVLD<br>SDGSFFLYSK LTVDKSRWQQ GNVFSCSVMH EALHNHYTQK<br>SLSLSPGK |
| 71 | SS-Siglec-9-Fc GWIYP to SQTDS; SS-S9.24-hIgG1 | MGWSCIILFL VATATGVHSS KLLTMQSSVT VQEGLCVHVP<br>CSFSYPSHSQ TDSGPVVHGY WFREGANTDQ DAPVATNNPA<br>RAVWEETRDR FHLLGDPHTK NCTLSIRDAR RSDAGRYFFR<br>MEKGSIKWNY KHHRLSVNVT ALTHRPNILI PGTLESGCPQ |

| SEQ ID NO | Description | Sequence |
|---|---|---|
| | | NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLILCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKENWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 72 | SS-Siglec-9-Fc SHGWIYPG to VDSQTDSD; SS-S9.25-hIgG1 | MGWSCIILFL VATATGVHSS KLLTMQSSVT VQEGLCVHVP CSFSYPVDSQ TDSDPVVHG YWFREGANTD QDAPVATNNP ARAVWE<u>E</u>TRD RPHLLGDPHT KNCTLSIRDA RRSDAGRYFF RMEKGSIKWN YKHHRLSVNV TALTHRPNIL IPGTLESGCP QNLTCSVPWA CEQGTPPMIS WIGTSVSPLD PSTTRSSVLT LIPQPQDHGT SLTCQVTFPG ASVTTNKTVH LNVSYPPQNL TMTVFQGDGT VSTVLGNGSS LSLPEGQSLR LVCAVDAVDS NPPARLSLSW RGLTLCPSQP SNPGVLELPW VHLRDAAEFT CRAQNPLGSQ QVYLNVSEPK SCDKTHTCPP CPAPELLGGP SVFLFPPKPK DTLMISRTPE VTCVVVDVSH EDPEVKENWY VDGVEVHNAK TKPREEQYNS TYRVVSVLTV LHQDWLNGKE YKCKVSNKAL PAPIEKTISK AKGQPREPQV YTLPPSRDEL TKNQVSLTCL VKGFYPSDIA VEWESNGQPE NNYKTTPPVL DSDGSFFLYS KLTVDKSRWQ QGNVFSCSVM HEALHNHYTQ KSLSLSPGK |
| 73 | SS-Siglec-9-Fc SHGWIYPG to VHGQIDSD; SS-S9.26-hIgG1 | MGWSCIILFL VATATGVHSS KLLTMQSSVT VQEGLCVHVP CSFSYPVHGQ IDSDPVVHGY WFREGANTDQ DAPVATNNPA RAVWE<u>E</u>TRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKENWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SLSLSPGK LTVDKSRWQQ GNVFSCSVMH EALHNHYTQK SDGSFFLYSK |
| 74 | SS-Siglec-9-Fc SHGWIYPG to VHSQIDSD; SS-S9.27-hIgG1 | MGWSCIILFL VATATGVHSS KLLTMQSSVT VQEGLCVHVP CSFSYPVHSQ IDSDPVVHGY WFREGANTDQ DAPVATNNPA RAVWE<u>E</u>TRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW SVTTNKTVHL STTRSSVLTL IPQPQDHGTS LTCQVTFPGA IGTSVSPLDP NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYL<u>N</u>VSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 75 | SS-Siglec-9-Fc SHGWIYPG to VDSQIDSD; SS-S9.28-hIgG1 | MGWSCIILFL VATATGVHSS KLLTMQSSVT VQEGLCVHVP CSFSYPVDSQ IDSDPVVHGY WFREGANTDQ DAPVATNNPA RAVWE<u>E</u>TRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKENWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |

| SEQ ID NO | Description | Sequence |
|---|---|---|
| 76 | SS-Siglec-9-Fc SHGWIYPG to SDSQIDSD; SS-S9.29-hIgG1 | MGWSCIILFL VATATGVHSS KLLTMQSSVT VQEGLCVHVP CSFSYPSDSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 77 | SS-Siglec-9-Fc SHGWIYPG to VDGQIDSD; SS-S9.30-hIgG1 | MGWSCIILFL VATATGVHSS KLLTMQSSVT VQEGLCVHVP CSFSYPVDGQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 78 | Siglec-9 parental (WIYP); S9.1 (without signal sequence) | S KLLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 79 | Siglec-9 DIEG; S9.2 | S KLLTMQSSVT VQEGLCVHVP CSFSYPSHGD IEGGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 80 | Siglec-9 SIET; S9.3 | S KLLTMQSSVT VQEGLCVHVP CSFSYPSHGS IETGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 81 | Siglec-9 SIEP; S9.4 | S KLLTMQSSVT VQEGLCVHVP CSFSYPSHGS IEPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 82 | Siglec-9 DIEP; S9.5 | S KLLTMQSSVT VQEGLCVHVP CSFSYPSHGD IEPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |

-continued

| SEQ ID NO | Description | Sequence |
|---|---|---|
| 83 | Siglec-9 YQES; S9.6 | S KLLTMQSSVT VQEGLCVHVP CSFSYPSHGY QESGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 84 | Siglec-9 THET; S9.7 | S KLLTMQSSVT VQEGLCVHVP CSFSYPSHGT HETGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 85 | Siglec-9 L23T H26S H80Y L82E; S9.8 | S KLLTMQSSVT VQEGTCVSVP CSFSYPSHGW IYPGPVVHGY WFREGANTDQ DAPVATNNPA RAVWEETRDR FYLEGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 86 | Siglec-9 L23T H26T H80Y L82D; S9.9 | S KLLTMQSSVT VQEGTCVTVP CSFSYPSHGW IYPGPVVHGY WFREGANTDQ DAPVATNNPA RAVWEETRDR FYLDGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 87 | Siglec-9 S35D W38T; S9.10 | S KLLTMQSSVT VQEGLCVHVP CSFSYPDHGT IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 88 | Siglec-9 S35D W38E; S9.11 | S KLLTMQSSVT VQEGLCVHVP CSFSYPDHGE IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 89 | Siglec-9 W38S 139H Y40H; S9.12 | S KLLTMQSSVT VQEGLCVHVP CSFSYPSHGS HHPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 90 | Siglec-9 S35D W38Q I39H Y40E; S9.13 | S KLLTMQSSVT VQEGLCVHVP CSFSYPDHGQ HEPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 91 | Siglec-9 S35T W38Q I39H Y40E; S9.14 | S KLLTMQSSVT VQEGLCVHVP CSFSYPTHGS HEPGPVVHGY WFREGANTDQ DAPVATNNPA RAVWEETRDR FHLLGDPHTK NCTLSIRDAR RSDAGRYFFR MEKGSIKWNY KHHRLSVNVT |

-continued

| SEQ ID NO | Description | Sequence |
|---|---|---|
| | | ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 92 | Siglec-9 S35D W38E I39T; S9.15 | S KLLTMQSSVT VQEGLCVHVP CSFSYPDHGE TYPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 93 | Siglec-9 S35N W38E I39T; S9.16 | S KLLTMQSSVT VQEGLCVHVP CSFSYPNHGT EYPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 94 | Siglec-9 S35H W38T I39T Y40T; S9.17 | S KLLTMQSSVT VQEGLCVHVP CSFSYPHHGT TTPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 95 | Siglec-9 S35H W38S I39T Y40T; S9.18 | S KLLTMQSSVT VQEGLCVHVP CSFSYPHHGS TTPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 96 | Siglec-9 W38G I39T Y40E; S9.19 | S KLLTMQSSVT VQEGLCVHVP CSFSYPSHGG TEPGPVVHGY<br>WFREGANTDQ DAPVATNNPA RAVWEETRDR FHLLGDPHTK<br>NCTLSIRDAR RSDAGRYFFR MEKGSIKWNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 97 | Siglec-9 S8D K9Y L10T W116E; S9.20 | D YTLTMQSSVT VQEGLCVHVP CSFSYPSHGW IYPGPVVHGY<br>WFREGANTDQ DAPVATNNPA RAVWEETRDR FHLLGDPHTK<br>NCTLSIRDAR RSDAGRYFFR MEKGSIKENY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 98 | Siglec-9 S8D K9Y L10Q W116N; S9.21 | D YQLTMQSSVT VQEGLCVHVP CSFSYPSHGW IYPGPVVHGY<br>WFREGANTDQ DAPVATNNPA RAVWEETRDR FHLLGDPHTK<br>NCTLSIRDAR RSDAGRYFFR MEKGSIKNNY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA<br>SVTTNKTVHL NVSYPPQNLT MTVFQGDGTV STVLGNGSSL<br>SLPEGQSLRL VCAVDAVDSN PPARLSLSWR GLTLCPSQPS<br>NPGVLELPWV HLRDAAEFTC RAQNPLGSQQ VYLNVS |
| 99 | Siglec-9 S8E K9Y L10T W116E; S9.22 | E YTLTMQSSVT VQEGLCVHVP CSFSYPSHGW IYPGPVVHGY<br>WFREGANTDQ DAPVATNNPA RAVWEETRDR FHLLGDPHTK<br>NCTLSIRDAR RSDAGRYFFR MEKGSIKENY KHHRLSVNVT<br>ALTHRPNILI PGTLESGCPQ NLTCSVPWAC EQGTPPMISW<br>IGTSVSPLDP STTRSSVLTL IPQPQDHGTS LTCQVTFPGA |

-continued

| SEQ ID NO | Description | Sequence |
|---|---|---|
| | | SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 100 | Siglec-9 WIYP to QTDS; S9.23 | S KLLTMQSSVT VQEGLCVHVP CSFSYPSHGQ TDSGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 101 | Siglec-9 GWIYP to SQTDS; S9.24 | S KLLTMQSSVT VQEGLCVHVP CSFSYPSHSQ TDSGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 102 | Siglec-9 SHGWIYPG to VDSQTDSD; S9.25 | S KLLTMQSSVT VQEGLCVHVP CSFSYPVDSQ TDSDPVVHG YWFREGANTD QDAPVATNNP ARAVWEETRD RFHLLGDPHT KNCTLSIRDA RRSDAGRYFF RMEKGSIKWN YKHHRLSVNV TALTHRPNIL IPGTLESGCP QNLTCSVPWA CEQGTPPMIS WIGTSVSPLD PSTTRSSVLT LIPQPQDHGT SLTCQVTFPG ASVTTNKTVH LNVSYPPQNL TMTVFQGDGT VSTVLGNGSS LSLPEGQSLR LVCAVDAVDS NPPARLSLSW RGLTLCPSQP SNPGVLELPW VHLRDAAEFT CRAQNPLGSQ QVYLNVS |
| 103 | Siglec-9 SHGWIYPG to VHGQIDSD; S9.26 | S KLLTMQSSVT VQEGLCVHVP CSFSYPVHGQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 104 | Siglec-9 SHGWIYPG to VHSQIDSD; S9.27 | S KLLTMQSSVT VQEGLCVHVP CSFSYPVHSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 105 | Siglec-9 SHGWIYPG to VDSQIDSD; S9.28 | S KLLTMQSSVT VQEGLCVHVP CSFSYPVDSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 106 | Siglec-9 SHGWIYPG to SDSQIDSD; S9.29 | S KLLTMQSSVT VQEGLCVHVP CSFSYPSDSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |
| 107 | Siglec-9 SHGWIYPG to VDGQIDSD; S9.30 | S KLLTMQSSVT VQEGLCVHVP CSFSYPVDGQ IDSDPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVS |

| SEQ ID NO | Description | Sequence |
|---|---|---|
| 108 | Siglec-9 parental (WIYP) IgV domain; S9.1-IgV (without signal sequence) | S KLLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKWNY KHHRLSVNVT |
| 109 | Siglec-9 DIEG IgV domain; S9.2-IgV | S KLLTMQSSVT VQEGLCVHVP CSFSYPSHGD IEGGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 110 | Siglec-9 SIET IgV domain; S9.3-IgV | S KLLTMQSSVT VQEGLCVHVP CSFSYPSHGS IETGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 111 | Siglec-9 SIEP IgV domain; S9.4-IgV | S KLLTMQSSVT VQEGLCVHVP CSFSYPSHGS IEPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 112 | Siglec-9 DIEP IgV domain; S9.5-IgV | S KLLTMQSSVT VQEGLCVHVP CSFSYPSHGD IEPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 113 | Siglec-9 YQES IgV domain; S9.6-IgV | S KLLTMQSSVT VQEGLCVHVP CSFSYPSHGY QESGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 114 | Siglec-9 THET IgV domain; S9.7-IgV | S KLLTMQSSVT VQEGLCVHVP CSFSYPSHGT HETGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 115 | Siglec-9 L23T H26S H80Y L82E IgV domain; S9.8-IgV | S KLLTMQSSVT VQEGTCVSVP CSFSYPSHGW IYPGPVVHGY WFREGANTDQ DAPVAT̲N̲N̲P̲A̲ RAVWEETRDR FYLEGDPHTK NCTLSIRDAR RSDAGRYFFR MEKGSIKWNY K̲H̲H̲R̲LSVNVT |
| 116 | Siglec-9 L23T H26T H80Y L82D IgV domain; S9.9-IgV | S KLLTMQSSVT VQEGTCVTVP CSFSYPSHGW IYPGPVVHGY WFREGANTDQ DAPVAT̲N̲N̲P̲A̲ RAVWEETRDR FYLDGDPHTK NCTLSIRDAR RSDAGRYFFR MEKGSIKWNY K̲H̲H̲R̲LSVNVT |
| 117 | Siglec-9 S35D W38T IgV domain; S9.10-IgV | S KLLTMQSSVT VQEGLCVHVP CSFSYPDHGT IYPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 118 | Siglec-9 S35D W38E IgV domain; S9.11-IgV | S KLLTMQSSVT VQEGLCVHVP CSFSYPDHGE IYPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 119 | Siglec-9 W38S I39H Y40H IgV domain; S9.12-IgV | S KLLTMQSSVT VQEGLCVHVP CSFSYPSHGS HHPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 120 | Siglec-9 S35D W38Q I39H Y40E IgV domain; S9.13-IgV | S KLLTMQSSVT VQEGLCVHVP CSFSYPDHGQ HEPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 121 | Siglec-9 S35T W38Q I39H Y40E IgV domain; S9.14-IgV | S KLLTMQSSVT VQEGLCVHVP CSFSYPTHGS HEPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 122 | Siglec-9 S35D W38E I39T IgV domain; S9.15-IgV | S KLLTMQSSVT VQEGLCVHVP CSFSYPDHGE TYPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 123 | Siglec-9 S35N W38E I39T IgV domain; S9.16-IgV | S KLLTMQSSVT VQEGLCVHVP CSFSYPNHGT EYPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 124 | Siglec-9 S35H W38T I39T Y40T IgV domain; S9.17-IgV | S KLLTMQSSVT VQEGLCVHVP CSFSYPHHGT TTPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 125 | Siglec-9 S35H W38S I39T Y40T IgV domain; S9.18-IgV | S KLLTMQSSVT VQEGLCVHVP CSFSYPHHGS TTPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |
| 126 | Siglec-9 W38G I39T Y40E IgV domain; S9.19-IgV | S KLLTMQSSVT VQEGLCVHVP CSFSYPSHGG TEPGPVVHGY WFREGANTDQ DAPVATNNPA RAVWEETRDR F̲H̲L̲L̲GDPHTK NCTLSIRDAR RSDAGRYFFR MEKGSIKWNY KHHRLSVNVT |

-continued

| SEQ ID NO | Description | Sequence |
|---|---|---|
| 127 | Siglec-9 S8D K9Y L10T W116E IgV domain; S9.20-IgV | D YTLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKENY KHHRLSVNVT |
| 128 | Siglec-9 S8D K9Y L10Q W116N IgV domain; S9.21-IgV | D YQLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKNNY KHHRLSVNVT |
| 129 | Siglec-9 S8E K9Y L10T W116E IgV domain; S9.22-IgV | E YTLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKENY KHHRLSVNVT |
| 130 | Siglec-9 WIYP to QTDS IgV domain; S9.23-IgV | S KLLTMQSSVT VQEGLCVHVP CSFSYPSHGQ TDSGPVVHGY WFREGANTDQ DAPVATNNPA RAVWEETRDR FHLLGDPHTK NCTLSIRDAR RSDAGRYFFR MEKGSIKWNY KHHRLSVNVT |
| 131 | Siglec-9 GWIYP to SQTDS IgV domain; S9.24-IgV | S KLLTMQSSVT VQEGLCVHVP CSFSYPSHSQ TDSGPVVHGY WFREGANTDQ DAPVATNNPA RAVWEETRDR FHLLGDPHTK NCTLSIRDAR RSDAGRYFFR MEKGSIKWNY KHHRLSVNVT |
| 132 | Siglec-9 SHGWIYPG to VDSQTDSD IgV domain; S9.25-IgV | S KLLTMQSSVT VQEGLCVHVP CSFSYPVDSQ TDSDPVVHG YWFREGANTD QDAPVATNNP ARAVWEETRD RFHLLGDPHT KNCTLSIRDA RRSDAGRYFF RMEKGSIKWN YKHHRLSVNVT |
| 133 | Siglec-9 SHGWIYPG to VHGQIDSD IgV domain; S9.26-IgV | S KLLTMQSSVT VQEGLCVHVP CSFSYPVHGQ IDSDPVVHGY WFREGANTDQ DAPVATNNPA RAVWEETRDR FHLLGDPHTK NCTLSIRDAR RSDAGRYFFR MEKGSIKWNY KHHRLSVNVT |
| 134 | Siglec-9 SHGWIYPG to VHSQIDSD IgV domain; S9.27-IgV | S KLLTMQSSVT VQEGLCVHVP CSFSYPVHSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT |
| 135 | Siglec-9 SHGWIYPG to VDSQIDSD IgV domain; S9.28-IgV | S KLLTMQSSVT VQEGLCVHVP CSFSYPVDSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT |
| 136 | Siglec-9 SHGWIYPG to SDSQIDSD IgV domain; S9.29-IgV | S KLLTMQSSVT VQEGLCVHVP CSFSYPSDSQ IDSDPVVHGY WFREGANTDQ DAPVATNNPA RAVWEETRDR FHLLGDPHTK NCTLSIRDAR RSDAGRYFFR MEKGSIKWNY KHHRLSVNVT |
| 137 | Siglec-9 SHGWIYPG to VDGQIDSD IgV domain; S9.30-IgV | S KLLTMQSSVT VQEGLCVHVP CSFSYPVDGQ IDSDPVVHGY WFREGANTDQ DAPVATNNPA RAVWEETRDR FHLLGDPHTK NCTLSIRDAR RSDAGRYFFR MEKGSIKWNY KHHRLSVNVT |
| 138 | SSopt-S9.A ECD (with optimized signal sequence) | MGWSCIILFL VATATGVHSS KLLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSLQSK ATSGVTQG |
| 139 | SSopt-S9.A ECD-hIgG1 (with optimized signal sequence from aa 1-19 and linker sequence (boxed) between ECD and hIgG1 Fc domain) | MGWSCIILFL VATATGVHSS KLLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSLRL VCAVDAVDSN PPARLSLSWR GLTLCPSQPS NPGVLELPWV HLRDAAEFTC RAQNPLGSQQ VYLNVSLQSK ATSGVTQGDI EGRMDPKSCD KTHTCPPCPA PELLGGPSVF LFPPKPKDTL MISRTPEVTC VVVDVSHEDP EVKFNWYVDG VEVHNAKTKP REEQYNSTYR VVSVLTVLHQ DWLNGKEYKC KVSNKALPAP IEKTISKAKG QPREPQVYTL PPSRDELTKN QVSLTCLVKG FYPSDIAVEW ESNGQPENNY KTTPPVLDSD GSFFLYSKLT VDKSRWQQGN VFSCSVMHEA LHNHYTQKSL SLSPGK |
| 140 | Native signal sequence | MLLLLLPLLW GRERAEGQT |
| 141 | Qptimized signal sequence | MGWSCIILFL VATATGVHS |

| SEQ ID NO | Description | Sequence |
|---|---|---|
| 142 | IgG1 wild-type | EPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 143 | IgG1 NSLF (N to S and L to F substitutions underlined) | EPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSSKAFP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 144 | IgG1 K322A | EPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCAVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 145 | IgG4 | ES KYGPPCPSCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKITPPVLDS DGSFFLYSRL TVDKSRWQEG NVFSCSVMHE ALHNHYTQKS LSLSLGK |
| 146 | IgG4 S228P | ES KYGPPCPPCP APEFLGGPSV FLFPPKPKDT LMISRTPEVT CVVVDVSQED PEVQFNWYVD GVEVHNAKTK PREEQFNSTY RVVSVLTVLH QDWLNGKEYK CKVSNKGLPS SIEKTISKAK GQPREPQVYT LPPSQEEMTK NQVSLTCLVK GFYPSDIAVE WESNGQPENN YKTTPPVLDS DGSFFLYSRL TVDKSRWQEG NVFSCSVMHE ALHNHYTQKS LSLSLGK |
| 147 | Membrane proximal region of Siglec-9 ECD | LQSKATSGVTQG |
| 148 | S9.32 - W38T - hIgG1 | SKLLTMQSSVTVQEGLCVHVPCSFSYPSHGTIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 149 | S9.33 - W38E - hIgG1 | SKLLTMQSSVTVQEGLCVHVPCSFSYPSHGEIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRIPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 150 | S9.34 - W38S - hIgG1 | SKLLTMQSSVTVQEGLCVHVPCSFSYPSHGSIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV |

| SEQ ID NO | Description | Sequence |
|---|---|---|
| | | YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 151 | S9.35 - W38A - hIgG1 | SKLLTMQSSVTVQEGLCVHVPCSFSYPSHGAIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSNKALPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 152 | S9.36 - W38R - hIgG1 | SKLLTMQSSVTVQEGLCVHVPCSFSYPSHGRIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSNKALPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 153 | S9.37 - W38Q - hIgG1 | SKLLTMQSSVTVQEGLCVHVPCSFSYPSHGQIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSNKALPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 154 | S9.38 - W38K - hIgG1 | SKLLTMQSSVTVQEGLCVHVPCSFSYPSHGKIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKIKPREEQYNSTYRVV<br>SVLTVLHQDWLNGKEYKCKVSNKALPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 155 | S9.39 - W38S_Y40T - hIgG1 | SKLLTMQSSVTVQEGLCVHVPCSFSYPSHGSITPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSNKALPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |

| SEQ ID NO | Description | Sequence |
|---|---|---|
| 156 | S9.41 - L_ER_R - hIgG1 | SKLLTMQSSVTVQEGLCVHVPCSFSYPSHGERYPGPVVHGYWFRE GANTDQDAPVATNNPARAVWEETRDRFHLLG<u>D</u>PHTKNCTLSIRDA RRSDAGRYFFRMEKGSIKRNYKHHRLSVNVTALTHRPNILIPGTL ESGCPQNLTCSVPWACEQ<u>G</u>TPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 157 | S9.42 - D_SI_R - hIgG1 | SKDLTMQSSVTVQEGLCVHVPCSFSYPSHGSIYPGPVVHGYWFRE GA<u>N</u>TDQDAPVATNNPARAVWEETRDRFHLLG<u>D</u>PHTKNCTLSIRDA RRSDAGRYFFRMEKGSIKRNYKHHRLSVNVTALTHRPNILIPGTL ESGCPQNLTCSVPWACEQ<u>G</u>TPPMISWIGTSVSPLDPSTTRSSVLT LIPQPQDHGTSLTCQVTFPGASVTTNKTVHL<u>N</u>VSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 158 | S9.43 - L_KI_R - hIgG1 | SKLLTMQSSVTVQEGLCVHVPCSFSYPSHGKIYPGPVVHGYWFRE GANTDQDAPVATNNPARAVWEETRDRFHLLG<u>D</u>PHTKNCTLSIRDA RRSDAGRYFFRMEKGSIKRNYKHHRLSVNVTALTHRPNILIPGTL ESGCPQNLTCSVPWACEQ<u>G</u>TPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDILMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 159 | S9.44 - T_EI_E - hIgG1 | SKTLTMQSSVTVQEGLCVHVPCSFSYPSHGEIYPGPVVHGYWFRE GA<u>N</u>TDQDAPVATNNPARAVWEETRDRFHLLG<u>D</u>PHTKNCTLSIRDA RRSDAGRYFFRMEKGSIKENYKHHRLSVNVTALTHRPNILIPGTL ESGCPQNLTCSVPWACEQ<u>G</u>TPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 160 | S9.45 - S_QI_R - hIgG1 | SKSLTMQSSVTVQEGLCVHVPCSFSYPSHGQIYPGPVVHGYWFRE GA<u>N</u>TDQDAPVATNNPARAVWEETRDRFHLLGDPHTKNCTLSIRDA RRSDAGRYFFRMEKGSIKRNYKHHRLSVNVTALTHRPNILIPGTL ESGCPQNLTCSVPWACEQ<u>G</u>TPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 161 | S9.47 - R_SS_I_T - hIgG1 | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESRCPQNLTCSVPWACEQGTPPMISWIGTSSSPLDPSTTRSSVLT LIP<u>T</u>PQDHGTSLTCQVTFPGASVTTNKTVHL<u>N</u>VSYPPQNLTMTVF |

| SEQ ID NO | Description | Sequence |
|---|---|---|
| | | QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 162 | S9.48 - R_DS_I_T - hIgG1 | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESRCPQNLTCSVPWACEQGTPPMISWIGTSDSPLDPSTTRSSVLT LIPPTPQDHGTSLTCQVTFPGASVTTNKTVHLTNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKIKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 163 | S9.49 - G_VT_Q_T - hIgG1 | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVTPLDPSTTRSSVLT LQPTPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 164 | S9.50 - N_TT_I_Q - hIgG1 | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESNCPQNLTCSVPWACEQGTPPMISWIGTSTTPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 165 | S9.51 - G_VK_I_E hIgG1 | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVKPLDPSTTRSSVLT LIPEPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV YTLPPSRDELTKNQVSLTCLVKGFYPSDIAVEWESNGQPENNYKT TPPVLDSDGSFFLYSKLTVDKSRWQQGNVFSCSVMHEALHNHYTQ KSLSLSPGK |
| 166 | S9.52 - R_SS_Q_T - hIgG1 | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESRCPQNLTCSVPWACEQGTPPMISWIGTSSSPLDPSTTRSSVLT LQPTPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VSEPKSCDKTHTCPPCPAPELLGGPSVFLFPPKPKDTLMISRTPE VTCVVVDVSHEDPEVKFNWYVDGVEVHNAKTKPREEQYNSTYRVV SVLTVLHQDWLNGKEYKCKVSNKALPAPIEKTISKAKGQPREPQV |

| SEQ ID NO | Description | Sequence |
|---|---|---|
| | | YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 167 | S9.53 - G_SK_Q_E - hIgG1 | SKLLTMQSSVTVQEGLCVHVPCSFSYPSHGWIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSSKPLDPSTTRSSVLT<br>LQPE**PQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSNKALPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 168 | S9.36 - W38R - hIgG1 NSLF | SKLLTMQSSVTVQEGLCVHVPCSFSYPSHGRIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSSKAFPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 169 | S9.37 - W38Q - hIgG1 NSLF | SKLLTMQSSVTVQEGLCVHVPCSFSYPSHGQIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSSKAFPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 170 | S9.38 - W38K - hIgG1 NSLF | SKLLTMQSSVTVQEGLCVHVPCSFSYPSHGKIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VSEPKSCDKTHTCPPCPAPELLGGPSVFLFPPKPKDTLMISRTPE<br>VTCVVVDVSHEDPEVKFNWYVDGVEVHNAKTKPREEQYNSTYRVV<br>SVLTVLHQDWLNGKEYKCKVSSKAFPAPIEKTISKAKGQPREPQV<br>YTLPPSRDELTKNQVSLTCLVKGFYPSDIAVEWESNGQPENNYKT<br>TPPVLDSDGSFFLYSKLTVDKSRWQQGNVFSCSVMHEALHNHYTQ<br>KSLSLSPGK |
| 171 | S9.32 (SS) - W38T - hIgG1 | MGWSCIILFLVATATGVHSSKLLTMQSSVTVQEGLCVHVPCSFSY<br>PSHGTIYPGPVVHGYWFREGANTDQDAPVATNNPARAVWEETRDR<br>FHLLGDPHTKNCTLSIRDARRSDAGRYFFRMEKGSIKWNYKHHRL<br>SVNVTALTHRPNILIPGTLESGCPQNLTCSVPWACEQGTPPMISW<br>IGTSVSPLDPSTTRSSVLTLIPQPQDHGTSLTCQVTFPGASVTTN<br>KTVHLNVSYPPQNLTMTVFQGDGTVSTVLGNGSSLSLPEGQSLRL<br>VCAVDAVDSNPPARLSLSWRGLILCPSQPSNPGVLELPWVHLRDA<br>AEFTCRAQNPLGSQQVYLNVSEPKSCDKTHTCPPCPAPELLGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKALP<br>APIEKTISKAKGQPREPQVYTLPPSRDELTKNQVSLTCLVKGFYP<br>SDIAVEWESNGQPENNYKTTPPVLDSDGSFFLYSKLTVDKSRWQQ<br>GNVFSCSVMHEALHNHYTQKSLSLSPGK |

| SEQ ID NO | Description | Sequence |
|---|---|---|
| 172 | S9.33 (SS) - W38E - hIgG1 | MGWSCIILFLVATATGVHSSKLLTMQSSVTVQEGLCVHVPCSFSY PSHGEIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKENWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 173 | S9.34 (SS) - W38S - hIgG1 | MGWSCIILFLVATATGVHSSKLLTMQSSVTVQEGLCVHVPCSFSY PSHGSIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 174 | S9.35 (SS) - W38A - hIgG1 | MGWSCIILFLVATATGVHSSKLLTMQSSVTVQEGLCVHVPCSFSY PSHGAIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 175 | S9.36 (SS) - W38R - hIgG1 | MGWSCIILFLVATATGVHSSKLLTMQSSVTVQEGLCVHVPCSFSY PSHGRIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 176 | S9.37 (SS) - W38Q - hIgG1 | MGWSCIILFLVATATGVHSSKLLTMQSSVTVQEGLCVHVPCSFSY PSHGQIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 177 | S9.38 (SS) - W38K - hIgG1 | MGWSCIILFLVATATGVHSSKLLTMQSSVTVQEGLCVHVPCSFSY PSHGKIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN |

| SEQ ID NO | Description | Sequence |
|---|---|---|
| | | KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 178 | S9.39 (SS) - W38S_Y40T - hIgG1 | MGWSCIILFLVATATGVHSSKLLTMQSSVTVQEGLCVHVPCSFSY PSHGSITPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 179 | S9.41 (SS) - L_ER_R - hIgG1 | MGWSCIILFLVATATGVHSSKLLTMQSSVTVQEGLCVHVPCSFSY PSHGERYPGPVVHGYWFREGANTDQDAPVATNNPARAVWEETRDR FHLLGDPHTKNCTLSIRDARRSDAGRYFFRMEKGSIKRNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 180 | S9.42 (SS) - D_SI_R - hIgG1 | MGWSCIILFLVATATGVHSSKDLTMQSSVTVQEGLCVHVPCSFSY PSHGSIYPGVVHGYWFREGANTDQDAPVATNNPARAVWEETRDR FHLLGDPHTKNCTLSIRDARRSDAGRYFFRMEKGSIKRNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKENWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 181 | S9.43 (SS) - L_KI_R - hIgG1 | MGWSCIILFLVATATGVHSSKLLTMQSSVTVQEGLCVHVPCSFSY PSHGKIYPGVVHGYWFREGANTDQDAPVATNNPARAVWEETRDR FHLLGDPHTKNCTLSIRDARRSDAGRYFFRMEKGSIKRNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLILCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKENWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 182 | S9.44 (SS) - T_EI_E - hIgG1 | MGWSCIILFLVATATGVHSSKTLTMQSSVTVQEGLCVHVPCSFSY PSHGEIYPGVVHGYWFREGANTDQDAPVATNNPARAVWEETRDR FHLLGDPHTKNCTLSIRDARRSDAGRYFFRMEKGSIKENYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP |

| SEQ ID NO | Description | Sequence |
|---|---|---|
| | | SDIAVEWESNGQPENNYKTTPPVLDSDGSFFLYSKLTVDKSRWQQ<br>GNVFSCSVMHEALHNHYTQKSLSLSPGK |
| 183 | S9.45 (SS) - S_QI_R - hIgG1 | MGWSCIILFLVATATGVHSSKSLTMQSSVTVQEGLCVHVPCSFSY<br>PSHGQIYPGPVVHGYWFREGANTDQDAPVATNNPARAVWEETRDR<br>FHLLGDPHTKNCTLSIRDARRSDAGRYFFRMEKGSIKRNYKHHRL<br>SVNVTALTHRPNILIPGTLESGCPQNLTCSVPWACEQGTPPMISW<br>IGTSVSPLDPSTTRSSVLTLIPQPQDHGTSLTCQVTFPGASVTTN<br>KTVHLNVSYPPQNLTMTVFQGDGTVSTVLGNGSSLSLPEGQSLRL<br>VCAVDAVDSNPPARLSLSWRGLILCPSQPSNPGVLELPWVHLRDA<br>AEFTCRAQNPLGSQQVYLNVSEPKSCDKTHTCPPCPAPELLGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKALP<br>APIEKTISKAKGQPREPQVYTLPPSRDELTKNQVSLTCLVKGFYP<br>SDIAVEWESNGQPENNYKTTPPVLDSDGSFFLYSKLTVDKSRWQQ<br>GNVFSCSVMHEALHNHYTQKSLSLSPGK |
| 184 | S9.47 (SS) - R_SS_I_T - hIgG1 | MGWSCIILFLVATATGVHSSKLLTMQSSVTVQEGLCVHVPCSFSY<br>PSHGWIYPGPVVHGYWFREGANTDQDAPVATNNPARAVWEETRDR<br>FHLLGDPHTKNCTLSIRDARRSDAGRYFFRMEKGSIKWNYKHHRL<br>SVNVTALTHRPNILIPGTLESRCPQNLTCSVPWACEQGTPPMISW<br>IGTSSSPLDPSTTRSSVLTLIPTPQDHGTSLTCQVTFPGASVTTN<br>KTVHLNVSYPPQNLTMTVFQGDGTVSTVLGNGSSLSLPEGQSLRL<br>VCAVDAVDSNPPARLSLSWRGLTLCPSQPSNPGVLELPWVHLRDA<br>AEFTCRAQNPLGSQQVYLNVSEPKSCDKTHTCPPCPAPELLGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKALP<br>APIEKTISKAKGQPREPQVYTLPPSRDELTKNQVSLTCLVKGFYP<br>SDIAVEWESNGQPENNYKTTPPVLDSDGSFFLYSKLTVDKSRWQQ<br>GNVFSCSVMHEALHNHYTQKSLSLSPGK |
| 185 | S9.48 (SS) - R_DS_I_T - hIgG1 | MGWSCIILFLVATATGVHSSKLLTMQSSVTVQEGLCVHVPCSFSY<br>PSHGWIYPGPVVHGYWFREGANTDQDAPVATNNPARAVWEETRDR<br>FHLLGDPHTKNCTLSIRDARRSDAGRYFFRMEKGSIKWNYKHHRL<br>SVNVTALTHRPNILIPGTLESRCPQNLTCSVPWACEQGTPPMISW<br>IGTSDSPLDPSTTRSSVLTLIPTPQDHGTSLTCQVTFPGASVTTN<br>KTVHLNVSYPPQNLTMTVFQGDGTVSTVLGNGSSLSLPEGQSLRL<br>VCAVDAVDSNPPARLSLSWRGLTLCPSQPSNPGVLELPWVHLRDA<br>AEFTCRAQNPLGSQQVYLNVSEPKSCDKTHTCPPCPAPELLGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKALP<br>APIEKTISKAKGQPREPQVYTLPPSRDELTKNQVSLTCLVKGFYP<br>SDIAVEWESNGQPENNYKTTPPVLDSDGSFFLYSKLTVDKSRWQQ<br>GNVFSCSVMHEALHNHYTQKSLSLSPGK |
| 186 | S9.49 (SS) - G_VT_Q_T - hIgG1 | MGWSCIILFLVATATGVHSSKLLTMQSSVTVQEGLCVHVPCSFSY<br>PSHGWIYPGPVVHGYWFREGANTDQDAPVATNNPARAVWEETRDR<br>FHLLGDPHTKNCTLSIRDARRSDAGRYFFRMEKGSIKWNYKHHRL<br>SVNVTALTHRPNILIPGTLESGCPQNLTCSVPWACEQGTPPMISW<br>IGTSVTPLDPSTTRSSVLTLQPTPQDHGTSLTCQVTFPGASVTTN<br>KTVHLNVSYPPQNLTMTVFQGDGTVSTVLGNGSSLSLPEGQSLRL<br>VCAVDAVDSNPPARLSLSWRGLTLCPSQPSNPGVLELPWVHLRDA<br>AEFTCRAQNPLGSQQVYLNVSEPKSCDKTHTCPPCPAPELLGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKALP<br>APIEKTISKAKGQPREPQVYTLPPSRDELTKNQVSLTCLVKGFYP<br>SDIAVEWESNGQPENNYKTTPPVLDSDGSFFLYSKLTVDKSRWQQ<br>GNVFSCSVMHEALHNHYTQKSLSLSPGK |
| 187 | S9.50 (SS) - N_TT_I_Q - hIgG1 | MGWSCIILFLVATATGVHSSKLLTMQSSVTVQEGLCVHVPCSFSY<br>PSHGWIYPGPVVHGYWFREGANTDQDAPVATNNPARAVWEETRDR<br>FHLLGDPHTKNCTLSIRDARRSDAGRYFFRMEKGSIKWNYKHHRL<br>SVNVTALTHRPNILIPGTLESNCPQNLTCSVPWACEQGTPPMISW<br>IGTSTTPLDPSTTRSSVLTLIPQPQDHGTSLTCQVTFPGASVTTN<br>KTVHLNVSYPPQNLTMTVFQGDGTVSTVLGNGSSLSLPEGQSLRL<br>VCAVDAVDSNPPARLSLSWRGLTLCPSQPSNPGVLELPWVHLRDA<br>AEFTCRAQNPLGSQQVYLNVSEPKSCDKTHTCPPCPAPELLGGPS<br>VFLFPPKPKDTLMISRTPEVTCVVVDVSHEDPEVKFNWYVDGVEV<br>HNAKTKPREEQYNSTYRVVSVLTVLHQDWLNGKEYKCKVSNKALP<br>APIEKTISKAKGQPREPQVYTLPPSRDELTKNQVSLTCLVKGFYP<br>SDIAVEWESNGQPENNYKTTPPVLDSDGSFFLYSKLTVDKSRWQQ<br>GNVFSCSVMHEALHNHYTQKSLSLSPGK |
| 188 | S9.51 (SS) - G_VK_I_E - hIgG1 | MGWSCIILFLVATATGVHSSKLLTMQSSVTVQEGLCVHVPCSFSY<br>PSHGWIYPGPVVHGYWFREGANTDQDAPVATNNPARAVWEETRDR<br>FHLLGDPHTKNCTLSIRDARRSDAGRYFFRMEKGSIKWNYKHHRL |

-continued

| SEQ ID NO | Description | Sequence |
|---|---|---|
| | | SVNVTALTHRPNILIPGTLESGCPQNLTCSVPWACEQGTPPMISW IGTSVKPLDPSTTRSSVLTLIPEPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKENWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 189 | S9.52 (SS) - R_SS_Q_T - hIgG1 | MGWSCIILFLVATATGVHSSKLLTMQSSVTVQEGLCVHVPCSFSY PSHGWIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESRCPQNLTCSVPWACEQGTPPMISW IGTSSSPLDPSTTRSSVLTLQPTPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 190 | S9.53 (SS) - G_SK_Q_E - hIgG1 | MGWSCIILFLVATATGVHSSKLLTMQSSVTVQEGLCVHVPCSFSY PSHGWIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSSKPLDPSTTRSSVLTLQPEPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 191 | S9.36 (SS) - W38R - hIgG1 NSLF | MGWSCIILFLVATATGVHSSKLLTMQSSVTVQEGLCVHVPCSFSY PSHGRIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKENWYVDGVEV HNAKTKPREEQYNSTYRVVSVLTVLHQDWLNGKEYKCKVSSKAFP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 192 | S9.37 (SS) - W38Q - hIgG1 NSLF | MGWSCIILFLVATATGVHSSKLLTMQSSVTVQEGLCVHVPCSFSY PSHGQIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLILCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSSKAFP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 193 | S9.38 (SS) - W38K - hIgG1 NSLF | MGWSCIILFLVATATGVHSSKLLTMQSSVTVQEGLCVHVPCSFSY PSHGKIYPGVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV |

-continued

| SEQ ID NO | Description | Sequence |
|---|---|---|
| | | HNAKTKPREEQYNSTYRVVSVLTVLHQDWLNGKEYKCKVSSKAFP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 194 | S9.32 (EC) - W38T | SKLLTMQSSVTVQEGLCVHVPCSFSYPSHGTIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 195 | S9.33 (EC) - W38E | SKLLTMQSSVTVQEGLCVHVPCSFSYPSHGEIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 196 | S9.34 (EC) - W38S | SKLLTMQSSVTVQEGLCVHVPCSFSYPSHGSIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 197 | S9.35 (EC) - W38A | SKLLTMQSSVTVQEGLCVHVPCSFSYPSHGAIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 198 | S9.36 (EC) - W38R | SKLLTMQSSVTVQEGLCVHVPCSFSYPSHGRIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 199 | S9.37 (EC) - W38Q | SKLLTMQSSVTVQEGLCVHVPCSFSYPSHGQIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 200 | S9.38 (EC) - W38K | SKLLTMQSSVTVQEGLCVHVPCSFSYPSHGKIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 201 | S9.39 (EC) - W38S_Y40T | SKLLTMQSSVTVQEGLCVHVPCSFSYPSHGSITPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVSPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |

| SEQ ID NO | Description | Sequence |
|---|---|---|
| 202 | S9.41 (EC) - L_ER_R | SKLLTMQSSVTVQEGLCVHVPCSFSYPSHGERYPGPVVHGYWFRE<br>GANTDQDAPVATNNPARAVWEETRDRFHLLGDPHTKNCTLSIRDA<br>RRSDAGRYFFRMEKGSIKRNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 203 | S9.42 (EC) - D_SI_R | SKDLTMQSSVTVQEGLCVHVPCSFSYPSHGSIYPGPVVHGYWFRE<br>GANTDQDAPVATNNPARAVWEETRDRFHLLGDPHTKNCTLSIRDA<br>RRSDAGRYFFRMEKGSIKRNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 204 | S9.43 (EC) - L_KI_R | SKLLTMQSSVTVQEGLCVHVPCSFSYPSHGKIYPGPVVHGYWFRE<br>GANTDQDAPVATNNPARAVWEETRDRFHLLGDPHTKNCTLSIRDA<br>RRSDAGRYFFRMEKGSIKRNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 205 | S9.44 (EC) - T_EI_E | SKTLTMQSSVTVQEGLCVHVPCSFSYPSHGEIYPGPVVHGYWFRE<br>GANTDQDAPVATNNPARAVWEETRDRFHLLGDPHTKNCTLSIRDA<br>RRSDAGRYFFRMEKGSIKENYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 206 | S9.45 (EC) - S_QI_R | SKSLTMQSSVTVQEGLCVHVPCSFSYPSHGQIYPGPVVHGYWFRE<br>GANTDQDAPVATNNPARAVWEETRDRFHLLGDPHTKNCTLSIRDA<br>RRSDAGRYFFRMEKGSIKRNYKHHRLSVNVTALTHRPNILIPGTL<br>ESGCPQNLTCSVPWACEQGTPPMISWIGTSVSPLDPSTTRSSVLT<br>LIPQPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 207 | S9.47 (EC) - R_SS_I_T | SKLLTMQSSVTVQEGLCVHVPCSFSYPSHGWIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESRCPQNLTCSVPWACEQGTPPMISWIGTSSSPLDPSTTRSSVLT<br>LIPTPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 208 | S9.48 (EC) - R_DS_I_T | SKLLTMQSSVTVQEGLCVHVPCSFSYPSHGWIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESRCPQNLTCSVPWACEQGTPPMISWIGTSDSPLDPSTTRSSVLT<br>LIPTPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 209 | S9.49 (EC) - G_VT_Q_T | SKLLTMQSSVTVQEGLCVHVPCSFSYPSHGWIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL<br>ESGCPQNLTCSVPWACEQGTPPMISWIGTSVTPLDPSTTRSSVLT<br>LQPTPQDHGTSLTCQVTFPGASVTTNKTVHLNVSYPPQNLTMTVF<br>QGDGTVSTVLGNGSSLSLPEGQSLRLVCAVDAVDSNPPARLSLSW<br>RGLTLCPSQPSNPGVLELPWVHLRDAAEFTCRAQNPLGSQQVYLN<br>VS |
| 210 | S9.50 (EC) - N_TT_I_Q | SKLLTMQSSVTVQEGLCVHVPCSFSYPSHGWIYPGPVVHGYWFRE<br>GANTDQDAPVATNNPARAVWEETRDRFHLLGDPHTKNCTLSIRDA<br>RRSDAGRYFFRMEKGSIKWNYKHHRLSVNVTALTHRPNILIPGTL |

| SEQ ID NO | Description | Sequence |
|---|---|---|
| | | ESNCPQNLTCSVPWACEQGTPPMISWIGTSTTPLDPSTTRSSVLT LIPQPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 211 | S9.51 (EC) - G_VK_I_E | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSVKPLDPSTTRSSVLT LIPEPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 212 | S9.52 (EC) - R_SS_Q_T | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESRCPQNLTCSVPWACEQGTPPMISWIGTSSSPLDPSTTRSSVLT LQPTPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 213 | S9.53 (EC) - G_SK_Q_E | SKLLTMQSSVTVQEGLCVHVPCSFSYPSHGWIYPGPVVHGYWFRE GANTDQDAPVATNNPARAVWEETRDRFHLLGDPHTKNCTLSIRDA RRSDAGRYFFRMEKGSIKWNYKHHRLSVNVTALTHRPNILIPGTL ESGCPQNLTCSVPWACEQGTPPMISWIGTSSKPLDPSTTRSSVLT LQPEPQDHGTSLTCQVTFPGASVTTNKTVHLNVSYPPQNLTMTVF QGDGTVSTVLGNGSSLSLPEGQSLRLVCAVDAVDSNPPARLSLSW RGLTLCPSQPSNPGVLELPWVHLRDAAEFTCRAQNPLGSQQVYLN VS |
| 214 | S9.32 (IgV) - W38T | SKLLTMQSSVTVQEGLCVHVPCSFSYPSHGTIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 215 | S9.33 (IgV) - W38E | SKLLTMQSSVTVQEGLCVHVPCSFSYPSHGEIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 216 | S9.34 (IgV) - W38S | SKLLTMQSSVTVQEGLCVHVPCSFSYPSHGSIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 217 | S9.35 (IgV) - W38A | SKLLTMQSSVTVQEGLCVHVPCSFSYPSHGAIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 218 | S9.36 (IgV) - W38R | SKLLTMQSSVTVQEGLCVHVPCSFSYPSHGRIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 219 | S9.37 (IgV) - W38Q | SKLLTMQSSVTVQEGLCVHVPCSFSYPSHGQIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 220 | S9.38 (IgV) - W38K | SKLLTMQSSVTVQEGLCVHVPCSFSYPSHGKIYPGPVVHGYWFRE GANTDQDAPVATNNPARAVWEETRDRFHLLGDPHTKNCTLSIRDA RRSDAGRYFFRMEKGSIKWNYKHHRLSVNVT |
| 221 | S9.39 (IgV) - W38S_Y40T | SKLLTMQSSVTVQEGLCVHVPCSFSYPSHGSITPGPVVHGYWFRE GANTDQDAPVATNNPARAVWEETRDRFHLLGDPHTKNCTLSIRDA RRSDAGRYFFRMEKGSIKWNYKHHRLSVNVT |
| 222 | S9.41 (IgV) - L_ER_R | SKLLTMQSSVTVQEGLCVHVPCSFSYPSHGERYPGPVVHGYWFRE GANTDQDAPVATNNPARAVWEETRDRFHLLGDPHTKNCTLSIRDA RRSDAGRYFFRMEKGSIKRNYKHHRLSVNVT |
| 223 | S9.42 (IgV) - D_SI_R | SKDLTMQSSVTVQEGLCVHVPCSFSYPSHGSIYPGPVVHGYWFRE GANTDQDAPVATNNPARAVWEETRDRFHLLGDPHTKNCTLSIRDA RRSDAGRYFFRMEKGSIKRNYKHHRLSVNVT |
| 224 | S9.43 (IgV) - L_KI_R | SKLLTMQSSVTVQEGLCVHVPCSFSYPSHGKIYPGPVVHGYWFRE GANTDQDAPVATNNPARAVWEETRDRFHLLGDPHTKNCTLSIRDA RRSDAGRYFFRMEKGSIKRNYKHHRLSVNVT |

| SEQ ID NO | Description | Sequence |
|---|---|---|
| 225 | S9.44 (IgV) - T_EI_E | SKTLTMQSSVTVQEGLCVHVPCSFSYPSHGEIYPGPVVHGYWFRE GANTDQDAPVATNNPARAVWEETRDRFHLLGDPHTKNCTLSIRDA RRSDAGRYFFRMEKGSIKENYKHHRLSVNVT |
| 226 | S9.45 (IgV) - S_QI_R | SKSLTMQSSVTVQEGLCVHVPCSFSYPSHGQIYPGPVVHGYWFRE GANTDQDAPVATNNPARAVWEETRDRFHLLGDPHTKNCTLSIRDA RRSDAGRYFFRMEKGSIKRNYKHHRLSVNVT |
| 227 | S9.1-hIgG1 NSLF (no SS) | S KLLTMQSSVT VQEGLCVHVP CSFSYPSHGW IYPGPVVHGY WFREGANTDQ DAPVATNNPA RAVWEETRDR FHLLGDPHTK NCTLSIRDAR RSDAGRYFFR MEKGSIKWNY KHHRLSVNVT ALTHRPNILI PGTLESGCPQ NLTCSVPWAC EQGTPPMISW IGTSVSPLDP STTRSSVLTL IPQPQDHGTS LTCQVTFPGA SVTTNKTVHL NVSYPPQNLT MTVFQGDGTV STVLGNGSSL SLPEGQSRL VCAVDAVDSN PPARLSLSWR GLTLCPSQPS NPGVLELPWV HLRDAAEFTC RAQNPLGSQQ VYLNVSEPKS CDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSSKAFP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| 228 | S9.1-hIgG1 NSLF YTE | MGWSCIILFLVATATGVHSSKLLTMQSSVTVQEGLCVHVPCSFSY PSHGWIYPGPVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLYITREPEVTCVVVDVSHEDPEVKFNWYVDGVEV HNAKTKPREEQYNSTYRVVSVLTVLHQDWLNGKEYKCKVSSKAFP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 229 | S9.1-hIgG1 NSLF LS | MGWSCIILFLVATATGVHSSKLLTMQSSVTVQEGLCVHVPCSFSY PSHGWIYPGPVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSSKAFP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVLHEALHSHYTQKSLSLSPGK |
| 230 | S9.1-hIgG1 NSLF LV5-112 | MGWSCIILFLVATATGVHSSKLLTMQSSVTVQEGLCVHVPCSFSY PSHGWIYPGPVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSSKAFP APIEKTISKAKGQPREPQVYTLPPSRDELTKNQVSLTCLVKGFYP SDIAVEWESNGGCALYPTNCGGGQPENNYKTTPPVLDSDGSFFLY SKLTVDKSRWQQGNVFSCSVMHEALHNHYTQKSLSLSPGK |
| 231 | S9.1-hIgG1 YTE | MGWSCIILFLVATATGVHSSKLLTMQSSVTVQEGLCVHVPCSFSY PSHGWIYPGPVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSRL VCAVDAVDSNPPARLSLSWRGLILCPSQPSNPGVLELPWVHLRDA AEFTCRAQNPLGSQQVYLNVSEPKSCDKTHTCPPCPAPELLGGPS VFLFPPKPKDTLYITREPEVTCVVVDVSHEDPEVKENWYVDGVEV HNAKTKPREEQYNSTYRVVSVLTVLHQDWLNGKEYKCKVSNKALP |

| SEQ ID NO | Description | Sequence |
|---|---|---|
| | | APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVMHEALHNHYTQKSLSLSPGK |
| 232 | S9.1-hIgG1 LS | MGWSCIILFLVATATGVHSSKLLTMQSSVTVQEGLCVHVPCSFSY PSHGWIYPGPVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGQPENNYKTTPPVLDSDGSFFLYSKLTVDKSRWQQ GNVFSCSVLHEALHSHYTQKSLSLSPGK |
| 233 | S9.1-hIgG1 LV5-112 | MGWSCIILFLVATATGVHSSKLLTMQSSVTVQEGLCVHVPCSFSY PSHGWIYPGPVVHGYWFREGANTDQDAPVATNNPARAVWEETRDR FHLLGDPHTKNCTLSIRDARRSDAGRYFFRMEKGSIKWNYKHHRL SVNVTALTHRPNILIPGTLESGCPQNLTCSVPWACEQGTPPMISW IGTSVSPLDPSTTRSSVLTLIPQPQDHGTSLTCQVTFPGASVTTN KTVHLNVSYPPQNLTMTVFQGDGTVSTVLGNGSSLSLPEGQSLRL VCAVDAVDSNPPARLSLSWRGLTLCPSQPSNPGVLELPWVHLRDA AEFTCRAQNPLGSQQVYLNVSEPKSCDKTHTCPPCPAPELLGGPS VFLFPPKPKDTLMISRTPEVTCVVVDVSHEDPEVKFNWYVDGVEV HNAKTKPREEQYNSTYRVVSVLTVLHQDWLNGKEYKCKVSNKALP APIEKTISKAKGQPREPQVYTLPPSRDELTKNQVSLTCLVKGFYP SDIAVEWESNGGCALYPTNCGGGQPENNYKTTPPVLDSDGSFFLY SKLTVDKSRWQQGNVFSCSVMHEALHNHYTQKSLSLSPGK |
| 234 | hIgG1 NSLF YTE | EPKSCDKTHTCPPCPAPELLGGPSVFLFPPKPKDTLYITREPEVT CVVVDVSHEDPEVKFNWYVDGVEVHNAKTKPREEQYNSTYRVVSV LTVLHQDWLNGKEYKCKVSSKAFPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVMHEALHNHYTQKS LSLSPGK |
| 235 | hIgG1 NSLF LS | EPKSCDKTHTCPPCPAPELLGGPSVFLFPPKPKDTLMISRTPEVT CVVVDVSHEDPEVKFNWYVDGVEVHNAKTKPREEQYNSTYRVVSV LTVLHQDWLNGKEYKCKVSSKAFPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVLHEALHSHYTQKS LSLSPGK |
| 236 | hIgG1 NSLF LV5-112 | EPKSCDKTHTCPPCPAPELLGGPSVFLFPPKPKDTLMISRTPEVT CVVVDVSHEDPEVKFNWYVDGVEVHNAKTKPREEQYNSTYRVVSV LTVLHQDWLNGKEYKCKVSSKAFPAPIEKTISKAKGQPREPQVYT LPPSRDELTKNQVSLTCLVKGFYPSDIAVEWESNGGCALYPINCG GGQPENNYKTTPPVLDSDGSFFLYSKLTVDKSRWQQGNVFSCSVM HEALHNHYTQKSLSLSPGK |
| 237 | hIgG1 YTE | EPKSCDKTHTCPPCPAPELLGGPSVFLFPPKPKDTLYITREPEVT CVVVDVSHEDPEVKFNWYVDGVEVHNAKTKPREEQYNSTYRVVSV LTVLHQDWLNGKEYKCKVSNKALPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVMHEALHNHYTQKS LSLSPGK |
| 238 | hIgG1 LS | EPKSCDKTHTCPPCPAPELLGGPSVFLFPPKPKDTLMISRTPEVT CVVVDVSHEDPEVKFNWYVDGVEVHNAKTKPREEQYNSTYRVVSV LTVLHQDWLNGKEYKCKVSNKALPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVLHEALHSHYTQKS LSLSPGK |
| 239 | hIgG1 LV5-112 | EPKSCDKTHTCPPCPAPELLGGPSVFLFPPKPKDTLMISRTPEVT CVVVDVSHEDPEVKFNWYVDGVEVHNAKTKPREEQYNSTYRVVSV LTVLHQDWLNGKEYKCKVSNKALPAPIEKTISKAKGQPREPQVYT LPPSRDELTKNQVSLTCLVKGFYPSDIAVEWESNGGCALYPTNCG GGQPENNYKTTPPVLDSDGSFFLYSKLTVDKSRWQQGNVFSCSVM HEALHNHYTQKSLSLSPGK |

SEQUENCE LISTING (239 sequences)

SEQ ID NO: 1 - protein, 463 aa, Homo sapiens
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 2 - protein, 444 aa, Homo sapiens
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 3 - protein, 5 aa, Artificial Sequence
  linker
ALTHR

SEQ ID NO: 4 - protein, 6 aa, Artificial Sequence
  linker
LNVSYP

SEQ ID NO: 5 - protein, 6 aa, Artificial Sequence
  ITIM motif
LQYASL

SEQ ID NO: 6 - protein, 6 aa, Artificial Sequence
  SLAM-like motif
TEYSEI

SEQ ID NO: 7 - protein, 121 aa, Homo sapiens
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 8 - protein, 8 aa, Artificial Sequence
  Siglec-7 loop
VDSQTDSD

SEQ ID NO: 9 - protein, 8 aa, Artificial Sequence
  Siglec-9 loop
SHGWIYPG

SEQ ID NO: 10 - protein, 549 aa, Artificial Sequence
  Siglec-9-Fc parental (WIYP); S9.1-hIgG1 (without signal sequence)
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 549 aa, Artificial Sequence
  Siglec-9-Fc DIEG; S9.2-hIgG1
SKLLTMQSSVTVQEGLCVHVPCSFSYPSHGDIEGGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 549 aa, Artificial Sequence
  Siglec-9-Fc SIET; S9.3-hIgG1
SKLLTMQSSVTVQEGLCVHVPCSFSYPSHGSIETGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 549 aa, Artificial Sequence
  Siglec-9-Fc SIEP; S9.4-hIgG1
SKLLTMQSSVTVQEGLCVHVPCSFSYPSHGSIEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14 - protein, 549 aa, Artificial Sequence
  Siglec-9-Fc DIEP; S9.5-hIgG1
SKLLTMQSSVTVQEGLCVHVPCSFSYPSHGDIEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 549 aa, Artificial Sequence
  Siglec-9-Fc YQES; S9.6-hIgG1
SKLLTMQSSVTVQEGLCVHVPCSFSYPSHGYQESGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 549 aa, Artificial Sequence
  Siglec-9-Fc THET; S9.7-hIgG1
SKLLTMQSSVTVQEGLCVHVPCSFSYPSHGTHETGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 549 aa, Artificial Sequence
  Siglec-9-Fc L23T H26S H80Y L82E; S9.8-hIgG1
SKLLTMQSSVTVQEGTCVSVPCSFSYPSHGWIYPGPVVHGYWFREGANTDQDAPVATNNPARAVWEETRDRFYLEGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 549 aa, Artificial Sequence
  Siglec-9-Fc L23T H26T H80Y L82D; S9.9-hIgG1
SKLLTMQSSVTVQEGTCVTVPCSFSYPSHGWIYPGPVVHGYWFREGANTDQDAPVATNNPARAVWEETRDRFYLDGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 549 aa, Artificial Sequence
  Siglec-9-Fc S35D W38T; S9.10-hIgG1
SKLLTMQSSVTVQEGLCVHVPCSFSYPDHGTIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 549 aa, Artificial Sequence
  Siglec-9-Fc S35D W38E; S9.11-hIgG1
SKLLTMQSSVTVQEGLCVHVPCSFSYPDHGEIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - protein, 549 aa, Artificial Sequence
  Siglec-9-Fc W38S I39H Y40H; S9.12-hIgG1
SKLLTMQSSVTVQEGLCVHVPCSFSYPSHGSHHPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 549 aa, Artificial Sequence
  Siglec-9-Fc S35D W38Q I39H Y40E; S9.13-hIgG1
SKLLTMQSSVTVQEGLCVHVPCSFSYPDHGQHEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 549 aa, Artificial Sequence
  Siglec-9-Fc S35T W38Q I39H Y40E; S9.14-hIgG1
SKLLTMQSSVTVQEGLCVHVPCSFSYPTHGSHEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 549 aa, Artificial Sequence
  Siglec-9-Fc S35D W38E I39T; S9.15-hIgG1
SKLLTMQSSVTVQEGLCVHVPCSFSYPDHGETYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 549 aa, Artificial Sequence
  Siglec-9-Fc S35N W38E I39T; S9.16-hIgG1
SKLLTMQSSVTVQEGLCVHVPCSFSYPNHGTEYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 549 aa, Artificial Sequence
  Siglec-9-Fc S35H W38T I39T Y40T; S9.17-hIgG1
SKLLTMQSSVTVQEGLCVHVPCSFSYPHHGTTTPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 549 aa, Artificial Sequence
  Siglec-9-Fc S35H W38S I39T Y40T; S9.18-hIgG1
SKLLTMQSSVTVQEGLCVHVPCSFSYPHHGSTTPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 549 aa, Artificial Sequence
  Siglec-9-Fc W38G I39T Y40E; S9.19-hIgG1
SKLLTMQSSVTVQEGLCVHVPCSFSYPSHGGTEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 549 aa, Artificial Sequence
  Siglec-9-Fc S8D K9Y L10T W116E; S9.20-hIgG1
DYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 549 aa, Artificial Sequence
  Siglec-9-Fc S8D K9Y L10Q W116N; S9.21-hIgG1
DYQLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKNNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 549 aa, Artificial Sequence
  Siglec-9-Fc S8E K9Y L10T W116E; S9.22-hIgG1
EYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 549 aa, Artificial Sequence
  Siglec-9-Fc WIYP to QTDS; S9.23-hIgG1
SKLLTMQSSVTVQEGLCVHVPCSFSYPSHGQTDSGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 549 aa, Artificial Sequence
  Siglec-9-Fc GWIYP to SQTDS; S9.24-hIgG1
SKLLTMQSSVTVQEGLCVHVPCSFSYPSHSQTDSGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 549 aa, Artificial Sequence
  Siglec-9-Fc SHGWIYPG to VDSQTDSD; S9.25-hIgG1
SKLLTMQSSVTVQEGLCVHVPCSFSYPVDSQTDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 549 aa, Artificial Sequence
  Siglec-9-Fc SHGWIYPG to VHGQIDSD; S9.26-hIgG1
SKLLTMQSSVTVQEGLCVHVPCSFSYPVHGQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 549 aa, Artificial Sequence
  Siglec-9-Fc SHGWIYPG to VHSQIDSD; S9.27-hIgG1
SKLLTMQSSVTVQEGLCVHVPCSFSYPVHSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 549 aa, Artificial Sequence
  Siglec-9-Fc SHGWIYPG to VDSQIDSD; S9.28-hIgG1
SKLLTMQSSVTVQEGLCVHVPCSFSYPVDSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 549 aa, Artificial Sequence
  Siglec-9-Fc SHGWIYPG to SDSQIDSD; S9.29-hIgG1
SKLLTMQSSVTVQEGLCVHVPCSFSYPSDSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 549 aa, Artificial Sequence
  Siglec-9-Fc SHGWIYPG to VDGQIDSD; S9.30-hIgG1
SKLLTMQSSVTVQEGLCVHVPCSFSYPVDGQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 586 aa, Artificial Sequence
  S9.A-hIgG1
  MISC_FEATURE (1)..(19): signal sequence
  MISC_FEATURE (20)..(586): mature sequence
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 586 aa, Artificial Sequence
  S9.A-hIgG1 NSLF
  MISC_FEATURE (1)..(19): signal sequence
  MISC_FEATURE (20)..(586): mature sequence
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 586 aa, Artificial Sequence
  S9.A-hIgG1 LALAPS
  MISC_FEATURE (1)..(19): signal sequence
  MISC_FEATURE (20)..(586): mature sequence
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGDIEGRMDPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 576 aa, Artificial Sequence
  S9.A-mIgG1
  MISC_FEATURE (1)..(19): signal sequence
  MISC_FEATURE (20)..(576): mature sequence
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGDIEGRMDCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 44 - protein, 587 aa, Artificial Sequence
  S9.B-mIgG2a
  MISC_FEATURE (1)..(19): signal sequence
  MISC_FEATURE (20)..(587): mature sequence
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGGGGGSIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 45 - protein, 568 aa, Artificial Sequence
  S9.1-hIgG1 NSLF
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 577 aa, Artificial Sequence
  S9.1-hIgG4 S228P
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 47 - protein, 568 aa, Artificial Sequence
  S9.1-hIgG1 K322A
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 568 aa, Artificial Sequence
  Signal sequence (SS)-Siglec-9-Fc parental (WIYP); SS-S9.1-hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 568 aa, Artificial Sequence
  SS-Siglec-9-Fc DIEG; SS-S9.2-hIgG1
MGWSCIILFLVATATGVHSSKLLTMQSSVTVQEGLCVHVPCSFSYPSHGDIEGGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 568 aa, Artificial Sequence
  SS-Siglec-9-Fc SIET; SS-S9.3-hIgG1
MGWSCIILFLVATATGVHSSKLLTMQSSVTVQEGLCVHVPCSFSYPSHGSIETGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 568 aa, Artificial Sequence
  SS-Siglec-9-Fc SIEP; SS-S9.4-hIgG1
MGWSCIILFLVATATGVHSSKLLTMQSSVTVQEGLCVHVPCSFSYPSHGSIEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 568 aa, Artificial Sequence
  SS-Siglec-9-Fc DIEP; SS-S9.5-hIgG1
MGWSCIILFLVATATGVHSSKLLTMQSSVTVQEGLCVHVPCSFSYPSHGDIEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 568 aa, Artificial Sequence
  SS-Siglec-9-Fc YQES; SS-S9.6-hIgG1
MGWSCIILFLVATATGVHSSKLLTMQSSVTVQEGLCVHVPCSFSYPSHGYQESGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 568 aa, Artificial Sequence
  SS-Siglec-9-Fc THET; SS-S9.7-hIgG1
MGWSCIILFLVATATGVHSSKLLTMQSSVTVQEGLCVHVPCSFSYPSHGTHETGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 568 aa, Artificial Sequence
  SS-Siglec-9-Fc L23T H26S H80Y L82E; SS-S9.8-hIgG1
MGWSCIILFLVATATGVHSSKLLTMQSSVTVQEGTCVSVPCSFSYPSHGWIYPGPVVHGYWFREGANTDQDAPVATNNPARAVWEETRDRFYLEGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 568 aa, Artificial Sequence
  SS-Siglec-9-Fc L23T H26T H80Y L82D; SS-S9.9-hIgG1
MGWSCIILFLVATATGVHSSKLLTMQSSVTVQEGTCVTVPCSFSYPSHGWIYPGPVVHGYWFREGANTDQDAPVATNNPARAVWEETRDRFYLDGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 568 aa, Artificial Sequence
  SS-Siglec-9-Fc S35D W38T; SS-S9.10-hIgG1
MGWSCIILFLVATATGVHSSKLLTMQSSVTVQEGLCVHVPCSFSYPDHGTIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 568 aa, Artificial Sequence
  SS-Siglec-9-Fc S35D W38E; SS-S9.11-hIgG1
MGWSCIILFLVATATGVHSSKLLTMQSSVTVQEGLCVHVPCSFSYPDHGEIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 568 aa, Artificial Sequence
  SS-Siglec-9-Fc W38S I39H Y40H; SS-S9.12-hIgG1
MGWSCIILFLVATATGVHSSKLLTMQSSVTVQEGLCVHVPCSFSYPSHGSHHPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 568 aa, Artificial Sequence
  SS-Siglec-9-Fc S35D W38Q I39H Y40E; SS-S9.13-hIgG1
MGWSCIILFLVATATGVHSSKLLTMQSSVTVQEGLCVHVPCSFSYPDHGQHEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 568 aa, Artificial Sequence
  SS-Siglec-9-Fc S35T W38Q I39H Y40E; SS-S9.14-hIgG1
MGWSCIILFLVATATGVHSSKLLTMQSSVTVQEGLCVHVPCSFSYPTHGSHEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 568 aa, Artificial Sequence
  SS-Siglec-9-Fc S35D W38E I39T; SS-S9.15-hIgG1
MGWSCIILFLVATATGVHSSKLLTMQSSVTVQEGLCVHVPCSFSYPDHGETYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 568 aa, Artificial Sequence
  SS-Siglec-9-Fc S35N W38E I39T; SS-S9.16-hIgG1
MGWSCIILFLVATATGVHSSKLLTMQSSVTVQEGLCVHVPCSFSYPNHGTEYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 568 aa, Artificial Sequence
  SS-Siglec-9-Fc S35H W38T I39T Y40T; SS-S9.17-hIgG1
MGWSCIILFLVATATGVHSSKLLTMQSSVTVQEGLCVHVPCSFSYPHHGTTTPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 568 aa, Artificial Sequence
  SS-Siglec-9-Fc S35H W38S I39T Y40T; SS-S9.18-hIgG1
MGWSCIILFLVATATGVHSSKLLTMQSSVTVQEGLCVHVPCSFSYPHHGSTTPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 568 aa, Artificial Sequence
  SS-Siglec-9-Fc W38G I39T Y40E; SS-S9.19-hIgG1
MGWSCIILFLVATATGVHSSKLLTMQSSVTVQEGLCVHVPCSFSYPSHGGTEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 568 aa, Artificial Sequence
  SS-Siglec-9-Fc S8D K9Y L10T W116E; SS-S9.20-hIgG1
MGWSCIILFLVATATGVHSDYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 568 aa, Artificial Sequence
  SS-Siglec-9-Fc S8D K9Y L10Q W116N; SS-S9.21-hIgG1
MGWSCIILFLVATATGVHSDYQLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKNNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 568 aa, Artificial Sequence
  SS-Siglec-9-Fc S8E K9Y L10T W116E; SS-S9.22-hIgG1
MGWSCIILFLVATATGVHSEYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 568 aa, Artificial Sequence
  SS-Siglec-9-Fc WIYP to QTDS; SS-S9.23-hIgG1
MGWSCIILFLVATATGVHSSKLLTMQSSVTVQEGLCVHVPCSFSYPSHGQTDSGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 568 aa, Artificial Sequence
  SS-Siglec-9-Fc GWIYP to SQTDS; SS-S9.24-hIgG1
MGWSCIILFLVATATGVHSSKLLTMQSSVTVQEGLCVHVPCSFSYPSHSQTDSGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 568 aa, Artificial Sequence
  SS-Siglec-9-Fc SHGWIYPG to VDSQTDSD; SS-S9.25-hIgG1
MGWSCIILFLVATATGVHSSKLLTMQSSVTVQEGLCVHVPCSFSYPVDSQTDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 568 aa, Artificial Sequence
  SS-Siglec-9-Fc SHGWIYPG to VHGQIDSD; SS-S9.26-hIgG1
MGWSCIILFLVATATGVHSSKLLTMQSSVTVQEGLCVHVPCSFSYPVHGQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 568 aa, Artificial Sequence
  SS-Siglec-9-Fc SHGWIYPG to VHSQIDSD; SS-S9.27-hIgG1
MGWSCIILFLVATATGVHSSKLLTMQSSVTVQEGLCVHVPCSFSYPVHSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 568 aa, Artificial Sequence
  SS-Siglec-9-Fc SHGWIYPG to VDSQIDSD; SS-S9.28-hIgG1
MGWSCIILFLVATATGVHSSKLLTMQSSVTVQEGLCVHVPCSFSYPVDSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 568 aa, Artificial Sequence
  SS-Siglec-9-Fc SHGWIYPG to SDSQIDSD; SS-S9.29-hIgG1
MGWSCIILFLVATATGVHSSKLLTMQSSVTVQEGLCVHVPCSFSYPSDSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 568 aa, Artificial Sequence
  SS-Siglec-9-Fc SHGWIYPG to VDGQIDSD; SS-S9.30-hIgG1
MGWSCIILFLVATATGVHSSKLLTMQSSVTVQEGLCVHVPCSFSYPVDGQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 317 aa, Artificial Sequence
  Siglec-9 parental (WIYP); S9.1 (without signal sequence)
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 79 - protein, 317 aa, Artificial Sequence
  Siglec-9 DIEG; S9.2
SKLLTMQSSVTVQEGLCVHVPCSFSYPSHGDIEGGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 80 - protein, 317 aa, Artificial Sequence
  Siglec-9 SIET; S9.3
SKLLTMQSSVTVQEGLCVHVPCSFSYPSHGSIETGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 81 - protein, 317 aa, Artificial Sequence
  Siglec-9 SIEP; S9.4
SKLLTMQSSVTVQEGLCVHVPCSFSYPSHGSIEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 82 - protein, 317 aa, Artificial Sequence
  Siglec-9 DIEP; S9.5
SKLLTMQSSVTVQEGLCVHVPCSFSYPSHGDIEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 83 - protein, 317 aa, Artificial Sequence
  Siglec-9 YQES; S9.6
SKLLTMQSSVTVQEGLCVHVPCSFSYPSHGYQESGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 84 - protein, 317 aa, Artificial Sequence
  Siglec-9 THET; S9.7
SKLLTMQSSVTVQEGLCVHVPCSFSYPSHGTHETGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 85 - protein, 317 aa, Artificial Sequence
  Siglec-9 L23T H26S H80Y L82E; S9.8
SKLLTMQSSVTVQEGTCVSVPCSFSYPSHGWIYPGPVVHGYWFREGANTDQDAPVATNNPARAVWEETRDRFYLEGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 86 - protein, 317 aa, Artificial Sequence
  Siglec-9 L23T H26T H80Y L82D; S9.9
SKLLTMQSSVTVQEGTCVTVPCSFSYPSHGWIYPGPVVHGYWFREGANTDQDAPVATNNPARAVWEETRDRFYLDGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 87 - protein, 317 aa, Artificial Sequence
  Siglec-9 S35D W38T; S9.10
SKLLTMQSSVTVQEGLCVHVPCSFSYPDHGTIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 88 - protein, 317 aa, Artificial Sequence
  Siglec-9 S35D W38E; S9.11
SKLLTMQSSVTVQEGLCVHVPCSFSYPDHGEIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 89 - protein, 317 aa, Artificial Sequence
  Siglec-9 W38S I39H Y40H; S9.12
SKLLTMQSSVTVQEGLCVHVPCSFSYPSHGSHHPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 90 - protein, 317 aa, Artificial Sequence
  Siglec-9 S35D W38Q I39H Y40E; S9.13
SKLLTMQSSVTVQEGLCVHVPCSFSYPDHGQHEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 91 - protein, 317 aa, Artificial Sequence
  Siglec-9 S35T W38Q I39H Y40E; S9.14
SKLLTMQSSVTVQEGLCVHVPCSFSYPTHGSHEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 92 - protein, 317 aa, Artificial Sequence
  Siglec-9 S35D W38E I39T; S9.15
SKLLTMQSSVTVQEGLCVHVPCSFSYPDHGETYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 93 - protein, 317 aa, Artificial Sequence
  Siglec-9 S35N W38E I39T; S9.16
SKLLTMQSSVTVQEGLCVHVPCSFSYPNHGTEYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 94 - protein, 317 aa, Artificial Sequence
  Siglec-9 S35H W38T I39T Y40T; S9.17
SKLLTMQSSVTVQEGLCVHVPCSFSYPHHGTTTPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 95 - protein, 317 aa, Artificial Sequence
  Siglec-9 S35H W38S I39T Y40T; S9.18
SKLLTMQSSVTVQEGLCVHVPCSFSYPHHGSTTPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 96 - protein, 317 aa, Artificial Sequence
  Siglec-9 W38G I39T Y40E; S9.19
SKLLTMQSSVTVQEGLCVHVPCSFSYPSHGGTEPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 97 - protein, 317 aa, Artificial Sequence
  Siglec-9 S8D K9Y L10T W116E; S9.20
DYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 98 - protein, 317 aa, Artificial Sequence
  Siglec-9 S8D K9Y L10Q W116N; S9.21
DYQLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKNNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 99 - protein, 317 aa, Artificial Sequence
  Siglec-9 S8E K9Y L10T W116E; S9.22
EYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 100 - protein, 317 aa, Artificial Sequence
  Siglec-9 WIYP to QTDS; S9.23
SKLLTMQSSVTVQEGLCVHVPCSFSYPSHGQTDSGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 101 - protein, 317 aa, Artificial Sequence
  Siglec-9 GWIYP to SQTDS; S9.24
SKLLTMQSSVTVQEGLCVHVPCSFSYPSHSQTDSGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 102 - protein, 317 aa, Artificial Sequence
  Siglec-9 SHGWIYPG to VDSQTDSD; S9.25
SKLLTMQSSVTVQEGLCVHVPCSFSYPVDSQTDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 103 - protein, 317 aa, Artificial Sequence
  Siglec-9 SHGWIYPG to VHGQIDSD; S9.26
SKLLTMQSSVTVQEGLCVHVPCSFSYPVHGQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 104 - protein, 317 aa, Artificial Sequence
  Siglec-9 SHGWIYPG to VHSQIDSD; S9.27
SKLLTMQSSVTVQEGLCVHVPCSFSYPVHSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 105 - protein, 317 aa, Artificial Sequence
  Siglec-9 SHGWIYPG to VDSQIDSD; S9.28
SKLLTMQSSVTVQEGLCVHVPCSFSYPVDSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 106 - protein, 317 aa, Artificial Sequence
  Siglec-9 SHGWIYPG to SDSQIDSD; S9.29
SKLLTMQSSVTVQEGLCVHVPCSFSYPSDSQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 107 - protein, 317 aa, Artificial Sequence
  Siglec-9 SHGWIYPG to VDGQIDSD; S9.30
SKLLTMQSSVTVQEGLCVHVPCSFSYPVDGQIDSDPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 108 - protein, 121 aa, Artificial Sequence; identical to SEQ ID NO: 7
  Siglec-9 parental (WIYP) IgV domain; S9.1-IgV (without signal sequence)

SEQ ID NO: 109 - protein, 121 aa, Artificial Sequence
  Siglec-9 DIEG IgV domain; S9.2-IgV
SKLLTMQSSVTVQEGLCVHVPCSFSYPSHGDIEGGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 110 - protein, 121 aa, Artificial Sequence
  Siglec-9 SIET IgV domain; S9.3-IgV
SKLLTMQSSVTVQEGLCVHVPCSFSYPSHGSIETGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 111 - protein, 121 aa, Artificial Sequence
  Siglec-9 SIEP IgV domain; S9.4-IgV
SKLLTMQSSVTVQEGLCVHVPCSFSYPSHGSIEPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 112 - protein, 121 aa, Artificial Sequence
  Siglec-9 DIEP IgV domain; S9.5-IgV
SKLLTMQSSVTVQEGLCVHVPCSFSYPSHGDIEPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 113 - protein, 121 aa, Artificial Sequence
  Siglec-9 YQES IgV domain; S9.6-IgV
SKLLTMQSSVTVQEGLCVHVPCSFSYPSHGYQESGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 114 - protein, 121 aa, Artificial Sequence
  Siglec-9 THET IgV domain; S9.7-IgV
SKLLTMQSSVTVQEGLCVHVPCSFSYPSHGTHETGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 115 - protein, 121 aa, Artificial Sequence
  Siglec-9 L23T H26S H80Y L82E IgV domain; S9.8-IgV
SKLLTMQSSVTVQEGTCVSVPCSFSYPSHGWIYPGPVVHGYWFREGANTDQDAPVATNNPARAVWEETRDRFYLEGDPHTKNCTLSIRDARRSDAGRYFFRMEKGSIKWNYKHHRLSVNVT

SEQ ID NO: 116 - protein, 121 aa, Artificial Sequence
  Siglec-9 L23T H26T H80Y L82D IgV domain; S9.9-IgV
SKLLTMQSSVTVQEGTCVTVPCSFSYPSHGWIYPGPVVHGYWFREGANTDQDAPVATNNPARAVWEETRDRFYLDGDPHTKNCTLSIRDARRSDAGRYFFRMEKGSIKWNYKHHRLSVNVT

SEQ ID NO: 117 - protein, 121 aa, Artificial Sequence
  Siglec-9 S35D W38T IgV domain; S9.10-IgV
SKLLTMQSSVTVQEGLCVHVPCSFSYPDHGTIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 118 - protein, 121 aa, Artificial Sequence
  Siglec-9 S35D W38E IgV domain; S9.11-IgV
SKLLTMQSSVTVQEGLCVHVPCSFSYPDHGEIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 119 - protein, 121 aa, Artificial Sequence
  Siglec-9 W38S I39H Y40H IgV domain; S9.12-IgV
SKLLTMQSSVTVQEGLCVHVPCSFSYPSHGSHHPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 120 - protein, 121 aa, Artificial Sequence
  Siglec-9 S35D W38Q I39H Y40E IgV domain; S9.13-IgV
SKLLTMQSSVTVQEGLCVHVPCSFSYPDHGQHEPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 121 - protein, 121 aa, Artificial Sequence
  Siglec-9 S35T W38Q I39H Y40E IgV domain; S9.14-IgV
SKLLTMQSSVTVQEGLCVHVPCSFSYPTHGSHEPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 122 - protein, 121 aa, Artificial Sequence
  Siglec-9 S35D W38E I39T IgV domain; S9.15-IgV
SKLLTMQSSVTVQEGLCVHVPCSFSYPDHGETYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 123 - protein, 121 aa, Artificial Sequence
  Siglec-9 S35N W38E I39T IgV domain; S9.16-IgV
SKLLTMQSSVTVQEGLCVHVPCSFSYPNHGTEYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 124 - protein, 121 aa, Artificial Sequence
  Siglec-9 S35H W38T I39T Y40T IgV domain; S9.17-IgV
SKLLTMQSSVTVQEGLCVHVPCSFSYPHHGTTTPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 125 - protein, 121 aa, Artificial Sequence
  Siglec-9 S35H W38S I39T Y40T IgV domain; S9.18-IgV
SKLLTMQSSVTVQEGLCVHVPCSFSYPHHGSTTPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 126 - protein, 121 aa, Artificial Sequence
  Siglec-9 W38G I39T Y40E IgV domain; S9.19-IgV
SKLLTMQSSVTVQEGLCVHVPCSFSYPSHGGTEPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 127 - protein, 121 aa, Artificial Sequence
  Siglec-9 S8D K9Y L10T W116E IgV domain; S9.20-IgV
DYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVT

SEQ ID NO: 128 - protein, 121 aa, Artificial Sequence
  Siglec-9 S8D K9Y L10Q W116N IgV domain; S9.21-IgV
DYQLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKNNYKHHRLSVNVT

SEQ ID NO: 129 - protein, 121 aa, Artificial Sequence
  Siglec-9 S8E K9Y L10T W116E IgV domain; S9.22-IgV
EYTLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKENYKHHRLSVNVT

SEQ ID NO: 130 - protein, 121 aa, Artificial Sequence
  Siglec-9 WIYP to QTDS IgV domain; S9.23-IgV
SKLLTMQSSVTVQEGLCVHVPCSFSYPSHGQTDSGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 131 - protein, 121 aa, Artificial Sequence
  Siglec-9 GWIYP to SQTDS IgV domain; S9.24-IgV
SKLLTMQSSVTVQEGLCVHVPCSFSYPSHSQTDSGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 132 - protein, 121 aa, Artificial Sequence
  Siglec-9 SHGWIYPG to VDSQTDSD IgV domain; S9.25-IgV
SKLLTMQSSVTVQEGLCVHVPCSFSYPVDSQTDSDPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 133 - protein, 121 aa, Artificial Sequence
  Siglec-9 SHGWIYPG to VHGQIDSD IgV domain; S9.26-IgV
SKLLTMQSSVTVQEGLCVHVPCSFSYPVHGQIDSDPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 134 - protein, 121 aa, Artificial Sequence
  Siglec-9 SHGWIYPG to VHSQIDSD IgV domain; S9.27-IgV
SKLLTMQSSVTVQEGLCVHVPCSFSYPVHSQIDSDPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 135 - protein, 121 aa, Artificial Sequence
  Siglec-9 SHGWIYPG to VDSQIDSD IgV domain; S9.28-IgV
SKLLTMQSSVTVQEGLCVHVPCSFSYPVDSQIDSDPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 136 - protein, 121 aa, Artificial Sequence
  Siglec-9 SHGWIYPG to SDSQIDSD IgV domain; S9.29-IgV
SKLLTMQSSVTVQEGLCVHVPCSFSYPSDSQIDSDPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 137 - protein, 121 aa, Artificial Sequence
  Siglec-9 SHGWIYPG to VDGQIDSD IgV domain; S9.30-IgV
SKLLTMQSSVTVQEGLCVHVPCSFSYPVDGQIDSDPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 138 - protein, 348 aa, Artificial Sequence
  SSopt-S9.A ECD (with optimized signal sequence)
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQG

SEQ ID NO: 139 - protein, 586 aa, Artificial Sequence
  SSopt-S9.A ECD-hIgG1
  MISC_FEATURE (1)..(19): optimized signal sequence
  MISC_FEATURE (349)..(355): linker sequence between ECD and hIgG1 Fc domain
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 19 aa, Artificial Sequence
  Native signal sequence
MLLLLLPLLWGRERAEGQT

SEQ ID NO: 141 - protein, 19 aa, Artificial Sequence
  Optimized signal sequence
MGWSCIILFLVATATGVHS

SEQ ID NO: 142 - protein, 232 aa, Artificial Sequence
  IgG1 wild-type
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 232 aa, Artificial Sequence
  IgG1 NSLF
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 144 - protein, 232 aa, Artificial Sequence
  IgG1 K322A
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 229 aa, Artificial Sequence
  IgG4
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 146 - protein, 229 aa, Artificial Sequence
  IgG4 S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 147 - protein, 12 aa, Artificial Sequence
  Membrane proximal region of Siglec-9 ECD
LQSKATSGVTQG

SEQ ID NO: 148 - protein, 549 aa, Artificial Sequence
  S9.32 - W38T - hIgGI
SKLLTMQSSVTVQEGLCVHVPCSFSYPSHGTIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 549 aa, Artificial Sequence
  S9.33 - W38E - hIgG1
SKLLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 549 aa, Artificial Sequence
  S9.34 - W38S - hIgG1
SKLLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 549 aa, Artificial Sequence
  S9.35 - W38A - hIgG1
SKLLTMQSSVTVQEGLCVHVPCSFSYPSHGAIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 549 aa, Artificial Sequence
  S9.36 - W38R - hIgG1
SKLLTMQSSVTVQEGLCVHVPCSFSYPSHGRIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 549 aa, Artificial Sequence
  S9.37 - W38Q - hIgG1
SKLLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 549 aa, Artificial Sequence
  S9.38 - W38K - hIgG1
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 549 aa, Artificial Sequence
  S9.39 - W38S_Y40T - hIgG1
SKLLTMQSSVTVQEGLCVHVPCSFSYPSHGSITPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 549 aa, Artificial Sequence
  S9.41 - L_ER_R  - hIgG1
SKLLTMQSSVTVQEGLCVHVPCSFSYPSHGERYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 549 aa, Artificial Sequence
  S9.42 - D_SI_R - hIgG1
SKDLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 549 aa, Artificial Sequence
  S9.43 - L_KI_R  - hIgG1
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 549 aa, Artificial Sequence
  S9.44 - T_EI_E - hIgG1
SKTLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 549 aa, Artificial Sequence
  S9.45 - S_QI_R - hIgG1
SKSLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 549 aa, Artificial Sequence
  S9.47 - R_SS_I_T  - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSSSPLDPSTTRSSVLTLIPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 549 aa, Artificial Sequence
  S9.48 - R_DS_I_T   - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSDSPLDPSTTRSSVLTLIPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 549 aa, Artificial Sequence
  S9.49 - G_VT_Q_T - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVTPLDPSTTRSSVLTLQPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 549 aa, Artificial Sequence
  S9.50 - N_TT_I_Q  - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESNCPQNLTCSVPWACEQGTPPMISWIGTSTTPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 549 aa, Artificial Sequence
  S9.51 - G_VK_I_E   - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVKPLDPSTTRSSVLTLIPEPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - protein, 549 aa, Artificial Sequence
  S9.52 - R_SS_Q_T  - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSSSPLDPSTTRSSVLTLQPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 549 aa, Artificial Sequence
  S9.53 - G_SK_Q_E  - hIgG1
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSSKPLDPSTTRSSVLTLQPEPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 549 aa, Artificial Sequence
  S9.36 - W38R - hIgG1 NSLF
SKLLTMQSSVTVQEGLCVHVPCSFSYPSHGRIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 549 aa, Artificial Sequence
  S9.37 - W38Q - hIgG1 NSLF
SKLLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 549 aa, Artificial Sequence
  S9.38 - W38K - hIgG1 NSLF
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 568 aa, Artificial Sequence
  S9.32 (SS) - W38T - hIgG1
MGWSCIILFLVATATGVHSSKLLTMQSSVTVQEGLCVHVPCSFSYPSHGTIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 568 aa, Artificial Sequence
  S9.33 (SS) - W38E - hIgG1
MGWSCIILFLVATATGVHSSKLLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 568 aa, Artificial Sequence
  S9.34 (SS) - W38S - hIgG1
MGWSCIILFLVATATGVHSSKLLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 568 aa, Artificial Sequence
  S9.35 (SS) - W38A - hIgG1
MGWSCIILFLVATATGVHSSKLLTMQSSVTVQEGLCVHVPCSFSYPSHGAIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 568 aa, Artificial Sequence
  S9.36 (SS) - W38R - hIgG1
MGWSCIILFLVATATGVHSSKLLTMQSSVTVQEGLCVHVPCSFSYPSHGRIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 568 aa, Artificial Sequence
  S9.37 (SS) - W38Q - hIgG1
MGWSCIILFLVATATGVHSSKLLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 568 aa, Artificial Sequence
  S9.38 (SS) - W38K - hIgG1
MGWSCIILFLVATATGVHSSKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 568 aa, Artificial Sequence
  S9.39 (SS) - W38S_Y40T - hIgG1
MGWSCIILFLVATATGVHSSKLLTMQSSVTVQEGLCVHVPCSFSYPSHGSITPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 568 aa, Artificial Sequence
  S9.41 (SS) - L_ER_R - hIgG1
MGWSCIILFLVATATGVHSSKLLTMQSSVTVQEGLCVHVPCSFSYPSHGERYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 568 aa, Artificial Sequence
  S9.42 (SS) - D_SI_R - hIgG1
MGWSCIILFLVATATGVHSSKDLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 568 aa, Artificial Sequence
  S9.43 (SS) - L_KI_R - hIgG1
MGWSCIILFLVATATGVHSSKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 568 aa, Artificial Sequence
  S9.44 (SS) - T_EI_E - hIgG1
MGWSCIILFLVATATGVHSSKTLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 568 aa, Artificial Sequence
  S9.45 (SS) - S_QI_R - hIgG1
MGWSCIILFLVATATGVHSSKSLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 568 aa, Artificial Sequence
  S9.47 (SS) - R_SS_I_T - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSSSPLDPSTTRSSVLTLIPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 568 aa, Artificial Sequence
  S9.48 (SS) - R_DS_I_T - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSDSPLDPSTTRSSVLTLIPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - protein, 568 aa, Artificial Sequence
  S9.49 (SS) - G_VT_Q_T - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVTPLDPSTTRSSVLTLQPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 568 aa, Artificial Sequence
  S9.50 (SS) - N_TT_I_Q - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESNCPQNLTCSVPWACEQGTPPMISWIGTSTTPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 568 aa, Artificial Sequence
  S9.51 (SS) - G_VK_I_E - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVKPLDPSTTRSSVLTLIPEPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 568 aa, Artificial Sequence
  S9.52 (SS) - R_SS_Q_T - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSSSPLDPSTTRSSVLTLQPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 568 aa, Artificial Sequence
  S9.53 (SS) - G_SK_Q_E - hIgG1
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSSKPLDPSTTRSSVLTLQPEPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 568 aa, Artificial Sequence
  S9.36 (SS) - W38R - hIgG1 NSLF
MGWSCIILFLVATATGVHSSKLLTMQSSVTVQEGLCVHVPCSFSYPSHGRIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 568 aa, Artificial Sequence
  S9.37 (SS) - W38Q - hIgG1 NSLF
MGWSCIILFLVATATGVHSSKLLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 568 aa, Artificial Sequence
  S9.38 (SS) - W38K - hIgG1 NSLF
MGWSCIILFLVATATGVHSSKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - protein, 317 aa, Artificial Sequence
  S9.32 (EC) - W38T
SKLLTMQSSVTVQEGLCVHVPCSFSYPSHGTIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 195 - protein, 317 aa, Artificial Sequence
  S9.33 (EC) - W38E
SKLLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 196 - protein, 317 aa, Artificial Sequence
  S9.34 (EC) - W38S
SKLLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 197 - protein, 317 aa, Artificial Sequence
  S9.35 (EC) - W38A
SKLLTMQSSVTVQEGLCVHVPCSFSYPSHGAIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 198 - protein, 317 aa, Artificial Sequence
  S9.36 (EC) - W38R
SKLLTMQSSVTVQEGLCVHVPCSFSYPSHGRIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 199 - protein, 317 aa, Artificial Sequence
  S9.37 (EC) - W38Q
SKLLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 200 - protein, 317 aa, Artificial Sequence
  S9.38 (EC) - W38K
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 201 - protein, 317 aa, Artificial Sequence
  S9.39 (EC) - W38S_Y40T
SKLLTMQSSVTVQEGLCVHVPCSFSYPSHGSITPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 202 - protein, 317 aa, Artificial Sequence
  S9.41 (EC) - L_ER_R
SKLLTMQSSVTVQEGLCVHVPCSFSYPSHGERYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 203 - protein, 317 aa, Artificial Sequence
  S9.42 (EC) - D_SI_R
SKDLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 204 - protein, 317 aa, Artificial Sequence
  S9.43 (EC) - L_KI_R
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 205 - protein, 317 aa, Artificial Sequence
  S9.44 (EC) - T_EI_E
SKTLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKENYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 206 - protein, 317 aa, Artificial Sequence
  S9.45 (EC) - S_QI_R
SKSLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKRNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 207 - protein, 317 aa, Artificial Sequence
  S9.47 (EC) - R_SS_I_T
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSSSPLDPSTTRSSVLTLIPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 208 - protein, 317 aa, Artificial Sequence
  S9.48 (EC) - R_DS_I_T
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSDSPLDPSTTRSSVLTLIPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 209 - protein, 317 aa, Artificial Sequence
  S9.49 (EC) - G_VT_Q_T
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVTPLDPSTTRSSVLTLQPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 210 - protein, 317 aa, Artificial Sequence
  S9.50 (EC) - N_TT_I_Q
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESNCPQNLTCSVPWACEQGTPPMISWIGTSTTPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 211 - protein, 317 aa, Artificial Sequence
  S9.51 (EC) - G_VK_I_E
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVKPLDPSTTRSSVLTLIPEPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 212 - protein, 317 aa, Artificial Sequence
  S9.52 (EC) - R_SS_Q_T
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESRCPQNLTCSVPWACEQGTPPMISWIGTSSSPLDPSTTRSSVLTLQPTPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 213 - protein, 317 aa, Artificial Sequence
  S9.53 (EC) - G_SK_Q_E
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSSKPLDPSTTRSSVLTLQPEPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVS

SEQ ID NO: 214 - protein, 121 aa, Artificial Sequence
  S9.32 (IgV) - W38T
SKLLTMQSSVTVQEGLCVHVPCSFSYPSHGTIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 215 - protein, 121 aa, Artificial Sequence
  S9.33 (IgV) - W38E
SKLLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 216 - protein, 121 aa, Artificial Sequence
  S9.34 (IgV) - W38S
SKLLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 217 - protein, 121 aa, Artificial Sequence
  S9.35 (IgV) - W38A
SKLLTMQSSVTVQEGLCVHVPCSFSYPSHGAIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 218 - protein, 121 aa, Artificial Sequence
  S9.36 (IgV) - W38R
SKLLTMQSSVTVQEGLCVHVPCSFSYPSHGRIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 219 - protein, 121 aa, Artificial Sequence
  S9.37 (IgV) - W38Q
SKLLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 220 - protein, 121 aa, Artificial Sequence
  S9.38 (IgV) - W38K
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 221 - protein, 121 aa, Artificial Sequence
  S9.39 (IgV) - W38S_Y40T
SKLLTMQSSVTVQEGLCVHVPCSFSYPSHGSITPGPVVHGYWFREGANTDQDAPVATNNPARAVWEETRDRFHLLGDPHTKNCTLSIRDARRSDAGRYFFRMEKGSIKWNYKHHRLSVNVT

SEQ ID NO: 222 - protein, 121 aa, Artificial Sequence
  S9.41 (IgV) - L_ER_R
SKLLTMQSSVTVQEGLCVHVPCSFSYPSHGERYPGPVVHGYWFREGANTDQDAPVATNNPARAVWEETRDRFHLLGDPHTKNCTLSIRDARRSDAGRYFFRMEKGSIKRNYKHHRLSVNVT

SEQ ID NO: 223 - protein, 121 aa, Artificial Sequence
  S9.42 (IgV) - D_SI_R
SKDLTMQSSVTVQEGLCVHVPCSFSYPSHGSIYPGPVVHGYWFREGANTDQDAPVATNNPARAVWEETRDRFHLLGDPHTKNCTLSIRDARRSDAGRYFFRMEKGSIKRNYKHHRLSVNVT

SEQ ID NO: 224 - protein, 121 aa, Artificial Sequence
  S9.43 (IgV) - L_KI_R
SKLLTMQSSVTVQEGLCVHVPCSFSYPSHGKIYPGPVVHGYWFREGANTDQDAPVATNNPARAVWEETRDRFHLLGDPHTKNCTLSIRDARRSDAGRYFFRMEKGSIKRNYKHHRLSVNVT

SEQ ID NO: 225 - protein, 121 aa, Artificial Sequence
  S9.44 (IgV) - T_EI_E
SKTLTMQSSVTVQEGLCVHVPCSFSYPSHGEIYPGPVVHGYWFREGANTDQDAPVATNNPARAVWEETRDRFHLLGDPHTKNCTLSIRDARRSDAGRYFFRMEKGSIKENYKHHRLSVNVT

SEQ ID NO: 226 - protein, 121 aa, Artificial Sequence
  S9.45 (IgV) - S_QI_R
SKSLTMQSSVTVQEGLCVHVPCSFSYPSHGQIYPGPVVHGYWFREGANTDQDAPVATNNPARAVWEETRDRFHLLGDPHTKNCTLSIRDARRSDAGRYFFRMEKGSIKRNYKHHRLSVNVT

SEQ ID NO: 227 - protein, 549 aa, Artificial Sequence
  S9.1-hIgG1 NSLF (no SS)
SKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - protein, 568 aa, Artificial Sequence
  S9.1-hIgG1 NSLF YTE
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 568 aa, Artificial Sequence
  S9.1-hIgG1 NSLF LS
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 230 - protein, 580 aa, Artificial Sequence
  S9.1-hIgG1 NSLF LV5-112
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGGCALYPTNCGGGQPENNYKTTPPVLDSDGSFFLYSKLTVDKSRWQQGNVFSCSVMHEALHNHYTQKSLSLSPGK

SEQ ID NO: 231 - protein, 568 aa, Artificial Sequence
  S9.1-hIgG1 YTE
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 568 aa, Artificial Sequence
  S9.1-hIgG1 LS
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 233 - protein, 580 aa, Artificial Sequence
  S9.1-hIgG1 LV5-112
MGWSCIILFLVATATGVHSSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGGCALYPTNCGGGQPENNYKTTPPVLDSDGSFFLYSKLTVDKSRWQQGNVFSCSVMHEALHNHYTQKSLSLSPGK

SEQ ID NO: 234 - protein, 232 aa, Artificial Sequence
  hIgG1 NSLF YTE
EPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 232 aa, Artificial Sequence
  hIgG1 NSLF LS
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 236 - protein, 244 aa, Artificial Sequence
  hIgG1 NSLF LV5-112
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSSKAFPAPIEKTISKAKGQPREPQVYTLPPSRDELTKNQVSLTCLVKGFYPSDIAVEWESNGGCALYPTNCGGGQPENNYKTTPPVLDSDGSFFLYSKLTVDKSRWQQGNVFSCSVMHEALHNHYTQKSLSLSPGK

SEQ ID NO: 237 - protein, 232 aa, Artificial Sequence
  hIgG1 YTE
EPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 232 aa, Artificial Sequence
  hIgG1 LS
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 239 - protein, 244 aa, Artificial Sequence
  hIgG1 LV5-112
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGGCALYPTNCGGGQPENNYKTTPPVLDSDGSFFLYSKLTVDKSRWQQGNVFSCSVMHEALHNHYTQKSLSLSPGK

What is claimed is:

1. An isolated fusion polypeptide comprising a Siglec-9 extracellular domain (ECD) comprising the amino acid sequence of SEQ ID NO: 78 and lacking the amino acid sequence of SEQ ID NO: 147, wherein the Siglec-9 ECD is joined at its C-terminus to an Fc domain.

2. The isolated polypeptide of claim 1, wherein the Fc domain has a human IgG1 or IgG4 isotype.

3. The isolated polypeptide of claim 2, wherein the Fc domain has a human IgG1 isotype that has:
   a. reduced binding to FcγRIII;
   b. reduced antibody-dependent cellular cytotoxicity (ADCC) and/or reduced complement binding activity;
   c. increased binding to FcγRIIa; or
   d. any combination of a), b), and/or c),
relative to the IgG1 polypeptide of SEQ ID No: 142.

4. An isolated fusion polypeptide comprising a Siglec-9 extracellular domain (ECD) comprising the amino acid sequence of SEQ ID NO: 78 and lacking a membrane proximal region (MPR) comprising the amino acid sequence of SEQ ID NO: 147, wherein the Siglec-9 ECD is joined at its C-terminus to an Fc domain, wherein the Fc domain has a human IgG1 isotype and comprises an amino acid sequence selected from any one of SEQ ID NOs: 142-144 and 234-239.

5. The isolated polypeptide of claim 2, wherein the Fc domain comprises the amino acid sequence of SEQ ID NO: 142.

6. The isolated polypeptide of claim 2, wherein the polypeptide comprises the amino acid sequence of SEQ ID NO:10.

7. The isolated polypeptide of claim 2, wherein the Fc domain comprises the amino acid sequence of SEQ ID NO: 143.

8. The isolated polypeptide of claim 2, wherein the polypeptide comprises the amino acid sequence of SEQ ID NO: 227.

9. The isolated polypeptide of claim 2, wherein the Fc domain has a human IgG4 isotype and comprises the amino acid sequence of SEQ ID NO: 145 or 146.

10. The isolated polypeptide of claim 1, wherein the polypeptide comprises an amino acid sequence selected from any one of SEQ ID NOs: 45-48 and 228-233, optionally lacking its associated signal peptide.

11. The isolated polypeptide of claim 10, wherein the polypeptide comprises the amino acid sequence of SEQ ID NO: 45, optionally lacking its associated signal peptide.

12. The isolated polypeptide of claim 10, wherein the polypeptide comprises the amino acid sequence of SEQ ID NO: 48, lacking its associated signal peptide.

13. The isolated polypeptide of claim 1, wherein the polypeptide binds sialic acid on the surface of cells.

14. The isolated polypeptide of claim 13, wherein (a) the cells are tumor cells; (b) the cells express FcR; (c) the cells are myeloid cells; or (d) the cells are myeloid cells selected from monocytes, macrophages, dendritic cells, microglia, and myeloid-derived suppressor cells (MDSCs).

15. The isolated polypeptide of claim 1, wherein the polypeptide
   a. blocks cell binding of any one or more Siglec family members selected from Siglec-3, Siglec-5, Siglec-7, Siglec-9, Siglec-10, and Siglec-15;
   b. relieves MDSC-mediated suppression of T-cells, optionally as determined by measuring an increase in IFNγ expression or an increase in T-cell proliferation;
   c. repolarizes MDSCs to a pro-inflammatory phenotype;
   d. increases expression of CD86 on MDSCs, increases expression of CD11b on MDSCs, and/or decreases expression of CD163 on MDSCs;
   e. repolarizes tumor macrophages away from an M2 phenotype;
   f. reduces CD163+ and/or CD206+macrophages;
   g. induces expression of one or more chemokines selected from CCL3, CCL4, CCL5, CCL17, CXCL1, CXCL9, and IL-8 in MDSCs;
   h. reduces myeloid cell recruitment into the tumor microenvironment; or
   i. binds to MDSCs with an affinity of less than 100 nM, less than 50 nM, less than 25 nM, less than 20 nM, less than 10 nM, less than 5 nM, less than 2 nM, 1-50 nM, 1-25 nM, 1-20 nM, 1-10 nM, 1-5 nM, or 1-2 nM;
   j. any one or more of (a) through (i),
optionally wherein the MDSCs are human MDSCs and/or the macrophages are human macrophages.

16. An isolated nucleic acid comprising a nucleic acid sequence that encodes the isolated polypeptide of claim 1.

17. An expression vector comprising the isolated nucleic acid of claim 16.

18. A host cell comprising the expression vector of claim 17.

19. A method of producing a polypeptide comprising culturing the host cell of claim 18, and optionally further comprising isolating the polypeptide.

20. A pharmaceutical composition comprising the polypeptide of claim 1 and a pharmaceutically acceptable carrier.

* * * * *